US012692543B2

(12) United States Patent
Ramadass et al.

(10) Patent No.: US 12,692,543 B2
(45) Date of Patent: Jul. 28, 2026

(54) CHROMOSOME CONFORMATION MARKERS OF AUTISM SPECTRUM DISORDER

(71) Applicant: OXFORD BIODYNAMICS PLC, Oxford (GB)

(72) Inventors: Aroul Selvam Ramadass, Oxford (GB); Ewan Hunter, Oxford (GB); Alexandre Akoulitchev, Oxford (GB)

(73) Assignee: OXFORD BIODYNAMICS PLC, Oxford (GB)

( * ) Notice: Subject to any disclaimer, the term of this patent is extended or adjusted under 35 U.S.C. 154(b) by 1044 days.

(21) Appl. No.: 17/641,666

(22) PCT Filed: Sep. 10, 2020

(86) PCT No.: PCT/GB2020/052171
§ 371 (c)(1),
(2) Date: Mar. 9, 2022

(87) PCT Pub. No.: WO2021/048544
PCT Pub. Date: Mar. 18, 2021

(65) Prior Publication Data
US 2022/0333199 A1 Oct. 20, 2022

Related U.S. Application Data

(60) Provisional application No. 62/898,969, filed on Sep. 11, 2019.

(51) Int. Cl.
| | |
|---|---|
| *C12Q 1/6883* | (2018.01) |
| *C12Q 1/6809* | (2018.01) |
| *C12Q 1/6813* | (2018.01) |
| *C12Q 1/6851* | (2018.01) |
| *C12Q 1/6876* | (2018.01) |

(52) U.S. Cl.
CPC ......... *C12Q 1/6883* (2013.01); *C12Q 1/6809* (2013.01); *C12Q 1/6813* (2013.01); *C12Q 1/6851* (2013.01); *C12Q 1/6876* (2013.01); *C12Q 2600/106* (2013.01)

(58) Field of Classification Search
CPC .. C12Q 1/6883; C12Q 1/6813; C12Q 1/6876; C12Q 1/6809; C12Q 2600/106; C12Q 2521/301; C12Q 2521/501; C12Q 2523/101; C12Q 1/686; C12Q 1/6844; C12Q 1/6851
See application file for complete search history.

(56) References Cited

U.S. PATENT DOCUMENTS

2014/0349977 A1 11/2014 Sun

FOREIGN PATENT DOCUMENTS

| | | | |
|---|---|---|---|
| JP | 2016540000 A | 12/2016 | |
| JP | 2018027896 A | 2/2018 | |
| JP | 2018527016 A | 9/2018 | |
| WO | WO 2015/033134 A1 * | 3/2015 | ............... C12Q 1/68 |
| WO | 2015086836 | 6/2015 | |
| WO | 2016207647 | 12/2016 | |
| WO | 2016207653 | 12/2016 | |
| WO | 2018115802 | 6/2018 | |
| WO | 2019069067 | 4/2019 | |
| WO | 2019086898 | 5/2019 | |

OTHER PUBLICATIONS

Alshaker H, et al. Chromatin conformation changes in peripheral blood can detect prostate cancer and stratify disease risk groups. J Transl Med. Jan. 28, 2021;19(1):46 (Year: 2021).*
Davies JO, et al. How best to identify chromosomal interactions: a comparison of approaches. Nat Methods. Jan. 31, 2017;14(2):125-134 (Year: 2017).*
NEB Tm Calculator [Internet]. [cited Mar. 31, 2025]. Available from: https://tmcalculator.neb.com/#!/main (Year: 2025).*
Oomen ME, et al. Mitotic chromosomes harbor cell type and species-specific structural features within a universal looping architecture. bioRxiv. Dec. 9, 2023; doi:10.1101/2023.12.08.570796 (Year: 2023).*
Salter M, et al. Initial Identification of a Blood-Based Chromosome Conformation Signature for Aiding in the Diagnosis of Amyotrophic Lateral Sclerosis. EBioMedicine. Jul. 2018;33:169-184. Epub Jun. 23, 2018 (Year: 2018).*
ThermoFisher. PCR Primer Design Tips [Internet]. 2019 [cited Mar. 30, 2025]. Available from: https://www.thermofisher.com/blog/behindthebench/pcr-primer-design-tips/ (Year: 2019).*
Zhao YT, et al. Long genes linked to autism spectrum disorders harbor broad enhancer-like chromatin domains. Genome Res. Jul. 2018;28(7):933-942. Epub May 30, 2018 (Year: 2018).*
Carroll A. The Bayes Theorem: What Are the Odds? [Internet]. 2014 [cited Mar. 29, 2025]. Available from: https://nerdfighteria.info/v/ql2jej-6e-y (Year: 2014).*

(Continued)

*Primary Examiner* — Nancy J Leith
*Assistant Examiner* — Emma R Hoppe
(74) *Attorney, Agent, or Firm* — FisherBroyles, LLP; Adam K. Whiting; Adelaide K. Leitzel

(57) ABSTRACT

Processes and methods for analysing chromosome regions and interactions relating to prognosis of Autism Spectrum Disorder are provided herein. The processes detect the presence or absence of specific chromosomal conformations in subjects at risk for autism spectrum disorder.

5 Claims, 19 Drawing Sheets

Specification includes a Sequence Listing.

(56) References Cited

OTHER PUBLICATIONS

Miller DT, et al. Consensus statement: chromosomal microarray is a first-tier clinical diagnostic test for individuals with developmental disabilities or congenital anomalies. Am J Hum Genet. May 14, 2010;86(5):749-64 (Year: 2010).*

Loviglio MN, et al. Chromosomal contacts connect loci associated with autism, BMI and head circumference phenotypes. Mol Psychiatry. Jun. 2017;22(6):836-849. Epub May 31, 2016 (Year: 2016).*

Mazina V, Gerdts J, Trinh S, Ankenman K, Ward T, Dennis MY, Girirajan S, Eichler EE, Bernier R. Epigenetics of autism-related impairment: copy number variation and maternal infection. J Dev Behav Pediatr. Feb.-Mar. 2015;36(2):61-7 (Year: 2015).*

Gentilini D, et al. Epigenetics of Autism Spectrum Disorders: A Multi-level Analysis Combining Epi-signature, Age Acceleration, Epigenetic Drift and Rare Epivariations Using Public Datasets. Curr Neuropharmacol. 2023;21(11):2362-2373 (Year: 2023).*

Veritas Assessments—Autism Diagnostic Assessments [Internet]. Understanding Your Veritas Autism Diagnostic Assessment Report—Veritas Assessments; [cited Apr. 6, 2025]. Available from: https://www.veritasassessments.org/understanding-your-veritas-autism-diagnostic-assessment-report/ (Year: 2025).*

Qlik Cloud Help [Internet]. 2025 [cited Dec. 21, 2025]. Available from: https://help.qlik.com/en-US/cloud-services/Subsystems/Hub/Content/Sense_Hub/AutoML/feature-importance.htm (Year: 2025).*

Loviglio et al., "Chromosomal contacts connect loci associated with autism, BMI and head circumference phenotypes", Molecular Psychiatry 2017, 22, 836-849.

Ramadass, et al., EpiSwitch Methodology, 2018, 5 pages.

Chaste, Pauline, and Marion Leboyer. "Autism risk factors: genes, environment, and gene-environment interactions." Dialogues in clinical neuroscience (2022).

Medical Device Network, News, Nov. 12, 2018, 2 pages.

Samsam, Mohtashem, Raheleh Ahangari, and Saleh A. Naser. "Pathophysiology of autism spectrum disorders: revisiting gastro-intestinal involvement and immune imbalance." World journal of gastroenterology: WJG 20.29 (2014): 9942.

Grand et al, Chromatin Conformation Signatures Associated with Epigenetic Deregulation of the FIP1L1 and PDGFRA Genes, Blood, 2016, vol. 128, No. 22, #1525.

Ornoy A, Weinstein-Fudim L, Ergaz Z (2015) Reproductive Toxicology (2015) 56: 155-69.

Vohr BR, Poggi Davis E, Wanke CA, Krebs NF Pediatrics (2017) 139 (suppl1): S38-49.

* cited by examiner

*closest*

Similar to intersect, *closest* searches for overlapping features in A and B. In the event that no feature in B overlaps the current feature in A, *closest* will report the nearest (that is, least genomic distance from the start or end of A) feature in B. For example, one might want to find which is the closest gene to a significant GWAS polymorphism. Note that *closest* will report an overlapping feature as the closest—that is, it does not restrict to closest *non-overlapping* feature. The following iconic "cheatsheet" summarizes the functionality available through the various options provided by the *closest* tool.

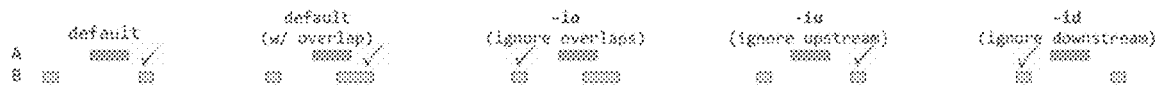

| | A | B | C | D | E | F | G | H | I | J |
|---|---|---|---|---|---|---|---|---|---|---|
| 1 | Chr | Start | Stop | ID | Chr | Start | Stop | | Gene | Distance |
| 2 | chrX | 39303922 | 39333882 | MA_20 | chrX | 38801432 | 38806537 | protein_coding MID1IP1 | -497386 |
| 3 | chr20 | 11126224 | 11199236 | MA_43 | chr20 | 10637684 | 10674107 | protein_coding JAG1 | -452118 |
| 4 | chr13 | 74443077 | 74486278 | MA_48 | chr13 | 73686089 | 74133905 | protein_coding KLF12 | -309173 |
| 5 | chr11 | 108858787 | 108890206 | MA_41 | chr11 | 108505431 | 108593738 | protein_coding EXPH5 | -265050 |
| 6 | chr12 | 14122272 | 14160836 | MA_13 | chr12 | 13537337 | 13981957 | protein_coding GRIN2B | -140316 |
| 7 | chr10 | 76410191 | 76462498 | MA_17 | chr10 | 76350749 | 76351228 | protein_coding AC013286.1 | -58964 |
| 8 | chr6 | 27448356 | 27518934 | MA_4 | chr6 | 27374615 | 27403904 | protein_coding ZNF391 | -44453 |
| 9 | chr13 | 51326485 | 51389062 | MA_15 | chr13 | 51222334 | 51284241 | protein_coding FAM124A | -42245 |
| 10 | chr11 | 75842855 | 75864724 | MA_40 | chr11 | 75759512 | 75801535 | protein_coding DGAT2 | -41321 |
| 11 | chr1 | 117665372 | 117695846 | MA_46 | chr1 | 117605934 | 117628372 | protein_coding FAM46C | -37001 |
| 12 | chr2 | 20261188 | 20369312 | MA_19 | chr2 | 20200797 | 20225433 | protein_coding SDC1 | -35756 |
| 13 | chr7 | 117353457 | 117425489 | MA_36 | chr7 | 117276631 | 117323289 | protein_coding WNT2 | -30169 |
| 14 | chr3 | 39211112 | 39287590 | MA_23 | chr3 | 39183210 | 39192596 | protein_coding XIRP1 | -18517 |
| 15 | chr6 | 154255952 | 154312070 | MA_1 | chr6 | 154010496 | 154246867 | protein_coding OPRM1 | -9086 |
| 16 | chr19 | 46479838 | 46545048 | MA_10 | chr19 | 46466491 | 46471563 | protein_coding PNMAL1 | -8276 |
| 17 | chrX | 11308534 | 11365389 | MA_9 | chrX | 11293413 | 11300761 | protein_coding AMELX | -7764 |
| 18 | chr13 | 45859224 | 45944992 | MA_12 | chr13 | 45777243 | 45851736 | protein_coding SIAH3 | -7489 |
| 19 | chr3 | 46488317 | 46536322 | MA_25 | chr3 | 46435645 | 46485234 | protein_coding LTF | -3084 |
| 20 | chr20 | 59933715 | 59977463 | MA_21 | chr20 | 59863563 | 59933655 | protein_coding SYCP2 | -61 |
| 21 | chr12 | 10096371 | 10158072 | MA_16 | chr12 | 10158301 | 10172138 | protein_coding OLR1 | 230 |
| 22 | chr5 | 159206195 | 159243123 | MA_3 | chr5 | 159263081 | 159286040 | protein_coding UBLCP1 | 19959 |
| 23 | chr8 | 89837286 | 89910373 | MA_29 | chr8 | 89933336 | 90003228 | protein_coding NBN | 22964 |

Figure 2 severe_TF mild_TF common_TF

| GeneSet | NumberOfProteinInGen... | ProteinFromNetwork | P-value | FDR | Nodes |
|---|---|---|---|---|---|
| Neurexins and neuroligins(R) | 50 | 5 | 7.0347E-05 | 0.0200 | GRIN2A,GRIN2B,DLG2... |
| Hippo signaling pathway -multiple species(K) | 29 | 4 | 1.1432E-04 | 0.0200 | WWC1,FRMD6,SAV1,F... |
| Hippo signaling pathway(K) | 154 | 7 | 3.3726E-04 | 0.0336 | WWC1,FRMD6,SAV1,W... |
| Nicotine addiction(K) | 40 | 4 | 3.8571E-04 | 0.0336 | GABRG2,GRIN2A,GRIN... |
| Neuroactive ligand-receptor interaction(K) | 278 | 8 | 2.4331E-03 | 0.1703 | HTR7,GABRG2,AGTR2... |
| Cell junction organization(R) | 70 | 4 | 2.9889E-03 | 0.1734 | CDH9,CDH10,CDH18... |
| Neurotransmitter receptors and postsynaptic signal trans... | 143 | 5 | 7.3227E-03 | 0.2676 | GABRG2,GRIN2A,GRIN... |
| Wnt signaling pathway(P) | 267 | 7 | 7.4188E-03 | 0.2676 | CDH9,WNT2,FZD3,CD... |
| Morphine addiction(K) | 91 | 4 | 7.4746E-03 | 0.2676 | GABRG2,OPRM1,GNG... |
| Signaling by Hippo(R) | 20 | 2 | 0.0125 | 0.2676 | WWC1,SAV1 |
| Synaptic adhesion-like molecules(R) | 20 | 2 | 0.0125 | 0.2676 | GRIN2A,GRIN2B |
| Notch signaling pathway(P) | 21 | 2 | 0.0137 | 0.2675 | JAG1,NUMB |
| Glutamatergic synapse(K) | 114 | 4 | 0.0159 | 0.2676 | GRIN2A,GRIN2B,DLGA... |
| Long-term potentiation(K) | 67 | 3 | 0.0192 | 0.2676 | GRIN2A,GRIN2B,PPP1R... |
| Reelin signaling pathway(N) | 28 | 2 | 0.0235 | 0.2676 | GRIN2A,GRIN2B |
| ErbB4 signaling events(N) | 28 | 2 | 0.0235 | 0.2676 | GRIN2B,TAB2 |
| G alpha (i) signalling events(R) | 345 | 7 | 0.0265 | 0.2676 | AGTR2,SDC1,OXGR1,... |
| Pentose phosphate pathway(K) | 30 | 2 | 0.0267 | 0.2676 | PGM2,FBP1 |
| Proteoglycan syndecan-mediated signaling events(N) | 4 | 1 | 0.0331 | 0.2676 | SDC1 |
| Galactose catabolism(R) | 4 | 1 | 0.0331 | 0.2676 | PGM2 |
| Cell adhesion molecules (CAMs)(K) | 145 | 4 | 0.0343 | 0.2676 | ALCAM,SDC1,CD34,N... |
| GABAergic synapse(K) | 88 | 3 | 0.0385 | 0.2676 | GABRG2,GNG2,GABRA1 |
| Signaling events mediated by HDAC Class II(N) | 38 | 2 | 0.0411 | 0.2676 | GNG2,BCOR |
| Protein repair(R) | 5 | 1 | 0.0412 | 0.2676 | MSRA |
| IL-17 signaling pathway(K) | 93 | 3 | 0.0441 | 0.2676 | TAB2,USP25,CCL20 |
| Class A/1 (Rhodopsin-like receptors)(R) | 308 | 6 | 0.0457 | 0.2676 | HTR7,AGTR2,OXGR1,... |
| Circadian entrainment(K) | 96 | 3 | 0.0476 | 0.2676 | GRIN2A,GRIN2B,GNG2 |

Figure 4

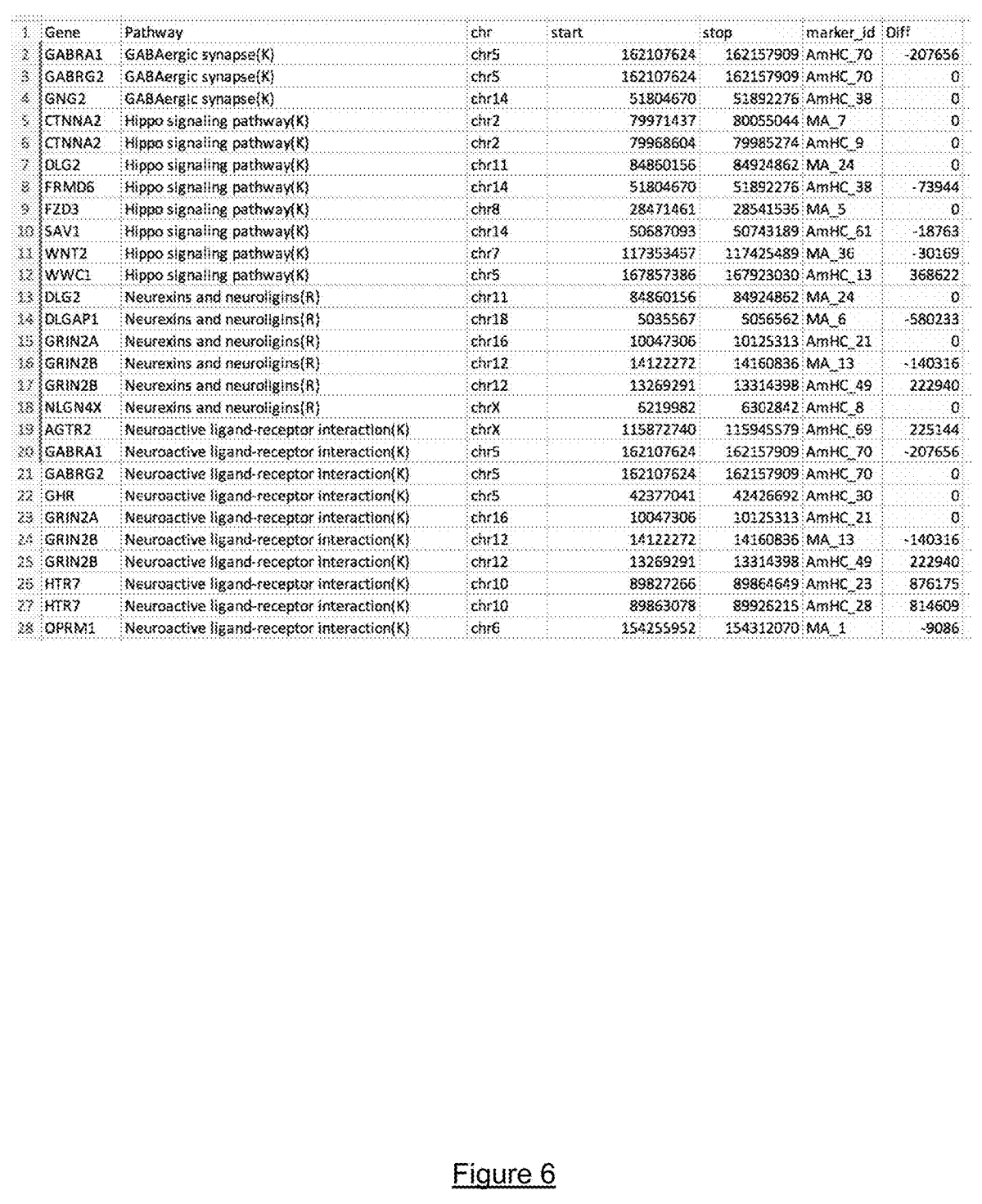

| | Gene | Pathway | chr | start | stop | marker_id | Diff |
|---|---|---|---|---|---|---|---|
| 1 | Gene | Pathway | chr | start | stop | marker_id | Diff |
| 2 | GABRA1 | GABAergic synapse(K) | chr5 | 162107624 | 162157909 | AmHC_70 | -207656 |
| 3 | GABRG2 | GABAergic synapse(K) | chr5 | 162107624 | 162157909 | AmHC_70 | 0 |
| 4 | GNG2 | GABAergic synapse(K) | chr14 | 51804670 | 51892276 | AmHC_38 | 0 |
| 5 | CTNNA2 | Hippo signaling pathway(K) | chr2 | 79971437 | 80055044 | MA_7 | 0 |
| 6 | CTNNA2 | Hippo signaling pathway(K) | chr2 | 79968604 | 79985274 | AmHC_9 | 0 |
| 7 | DLG2 | Hippo signaling pathway(K) | chr11 | 84860156 | 84924862 | MA_24 | 0 |
| 8 | FRMD6 | Hippo signaling pathway(K) | chr14 | 51804670 | 51892276 | AmHC_38 | -73944 |
| 9 | FZD3 | Hippo signaling pathway(K) | chr8 | 28471461 | 28541535 | MA_5 | 0 |
| 10 | SAV1 | Hippo signaling pathway(K) | chr14 | 50687093 | 50743189 | AmHC_61 | -18763 |
| 11 | WNT2 | Hippo signaling pathway(K) | chr7 | 117353457 | 117425489 | MA_36 | -30169 |
| 12 | WWC1 | Hippo signaling pathway(K) | chr5 | 167857386 | 167923030 | AmHC_13 | 368622 |
| 13 | DLG2 | Neurexins and neuroligins(R) | chr11 | 84860156 | 84924862 | MA_24 | 0 |
| 14 | DLGAP1 | Neurexins and neuroligins(R) | chr18 | 5035567 | 5056562 | MA_6 | -580233 |
| 15 | GRIN2A | Neurexins and neuroligins(R) | chr16 | 10047306 | 10125313 | AmHC_21 | 0 |
| 16 | GRIN2B | Neurexins and neuroligins(R) | chr12 | 14122272 | 14160836 | MA_13 | -140316 |
| 17 | GRIN2B | Neurexins and neuroligins(R) | chr12 | 13269291 | 13314398 | AmHC_49 | 222940 |
| 18 | NLGN4X | Neurexins and neuroligins(R) | chrX | 6219982 | 6302842 | AmHC_8 | 0 |
| 19 | AGTR2 | Neuroactive ligand-receptor interaction(K) | chrX | 115872740 | 115945579 | AmHC_69 | 225144 |
| 20 | GABRA1 | Neuroactive ligand-receptor interaction(K) | chr5 | 162107624 | 162157909 | AmHC_70 | -207656 |
| 21 | GABRG2 | Neuroactive ligand-receptor interaction(K) | chr5 | 162107624 | 162157909 | AmHC_70 | 0 |
| 22 | GHR | Neuroactive ligand-receptor interaction(K) | chr5 | 42377041 | 42426692 | AmHC_30 | 0 |
| 23 | GRIN2A | Neuroactive ligand-receptor interaction(K) | chr16 | 10047306 | 10125313 | AmHC_21 | 0 |
| 24 | GRIN2B | Neuroactive ligand-receptor interaction(K) | chr12 | 14122272 | 14160836 | MA_13 | -140316 |
| 25 | GRIN2B | Neuroactive ligand-receptor interaction(K) | chr12 | 13269291 | 13314398 | AmHC_49 | 222940 |
| 26 | HTR7 | Neuroactive ligand-receptor interaction(K) | chr10 | 89827266 | 89864649 | AmHC_23 | 876175 |
| 27 | HTR7 | Neuroactive ligand-receptor interaction(K) | chr10 | 89863078 | 89926215 | AmHC_28 | 814609 |
| 28 | OPRM1 | Neuroactive ligand-receptor interaction(K) | chr6 | 154255952 | 154312070 | MA_1 | -9086 |

Figure 6

| | A | B | C | D | E | F | G |
|---|---|---|---|---|---|---|---|
| 1 | Gene | Pathway | chr | start | stop | marker_id | Diff |
| 2 | IFNGR1 | IFN-gamma pathway(N) | chr6 | 137235679 | 137362789 | SA_25 | -16231 |
| 3 | PIK3R1 | IFN-gamma pathway(N) | chr5 | 68466125 | 68476885 | SA_22 | -164305 |
| 4 | PTPN2 | IFN-gamma pathway(N) | chr18 | 12837148 | 12853060 | AsHC_56 | 0 |
| 5 | RAPGEF1 | IFN-gamma pathway(N) | chr9 | 131592768 | 131654389 | SA_46 | 0 |
| 6 | GTF3A | IL4-mediated signaling events(N) | chr13 | 27276527 | 27312084 | AsHC_51 | 112461 |
| 7 | IL13RA1 | IL4-mediated signaling events(N) | chrX | 118654955 | 118725132 | AsHC_18 | 2441 |
| 8 | IL4R | IL4-mediated signaling events(N) | chr16 | 27283060 | 27360574 | AsHC_27 | 0 |
| 9 | IRF4 | IL4-mediated signaling events(N) | chr6 | 486539 | 555690 | SA_2 | -75093 |
| 10 | OPRM1 | IL4-mediated signaling events(N) | chr6 | 154259046 | 154298490 | AsHC_21 | -12180 |
| 11 | PIK3R1 | IL4-mediated signaling events(N) | chr5 | 68466125 | 68476885 | SA_22 | -164305 |
| 12 | CRLF2 | Jak-STAT signaling pathway(K) | chrX | 1174946 | 1242375 | AsHC_57 | 0 |
| 13 | CSF2RA | Jak-STAT signaling pathway(K) | chrX | 1174946 | 1242375 | AsHC_57 | 26426 |
| 14 | IFNGR1 | Jak-STAT signaling pathway(K) | chr6 | 137235679 | 137362789 | SA_25 | -16231 |
| 15 | IL13RA1 | Jak-STAT signaling pathway(K) | chrX | 118654955 | 118725132 | AsHC_18 | 2441 |
| 16 | IL4R | Jak-STAT signaling pathway(K) | chr16 | 27283060 | 27360574 | AsHC_27 | 0 |
| 17 | PIK3R1 | Jak-STAT signaling pathway(K) | chr5 | 68466125 | 68476885 | SA_22 | -164305 |
| 18 | PTPN2 | Jak-STAT signaling pathway(K) | chr18 | 12837148 | 12853060 | AsHC_56 | 0 |
| 19 | IFNGR1 | Natural killer cell mediated cytotoxicity(K) | chr6 | 137235679 | 137362789 | SA_25 | -16231 |
| 20 | KLRC1 | Natural killer cell mediated cytotoxicity(K) | chr12 | 10380286 | 10447112 | SA_4 | 0 |
| 21 | KLRC2 | Natural killer cell mediated cytotoxicity(K) | chr12 | 10380286 | 10447112 | SA_4 | 0 |
| 22 | KLRC3 | Natural killer cell mediated cytotoxicity(K) | chr12 | 10380286 | 10447112 | SA_4 | 0 |
| 23 | KLRD1 | Natural killer cell mediated cytotoxicity(K) | chr12 | 10380286 | 10447112 | SA_4 | -50687 |
| 24 | KLRD1 | Natural killer cell mediated cytotoxicity(K) | chr12 | 10187896 | 10218366 | SA_50 | 7693 |
| 25 | KLRK1 | Natural killer cell mediated cytotoxicity(K) | chr12 | 10380286 | 10447112 | SA_4 | 0 |
| 26 | PIK3R1 | Natural killer cell mediated cytotoxicity(K) | chr5 | 68466125 | 68476885 | SA_22 | -164305 |
| 27 | PPP3CC | Natural killer cell mediated cytotoxicity(K) | chr8 | 22339630 | 22373682 | AsHC_68 | 67138 |
| 28 | GRIN2A | Reelin signaling pathway(N) | chr16 | 10002949 | 10049395 | AsHC_16 | 0 |
| 29 | PIK3R1 | Reelin signaling pathway(N) | chr5 | 68466125 | 68476885 | SA_22 | -164305 |
| 30 | RAPGEF1 | Reelin signaling pathway(N) | chr9 | 131592768 | 131654389 | SA_46 | 0 |

Figure 7

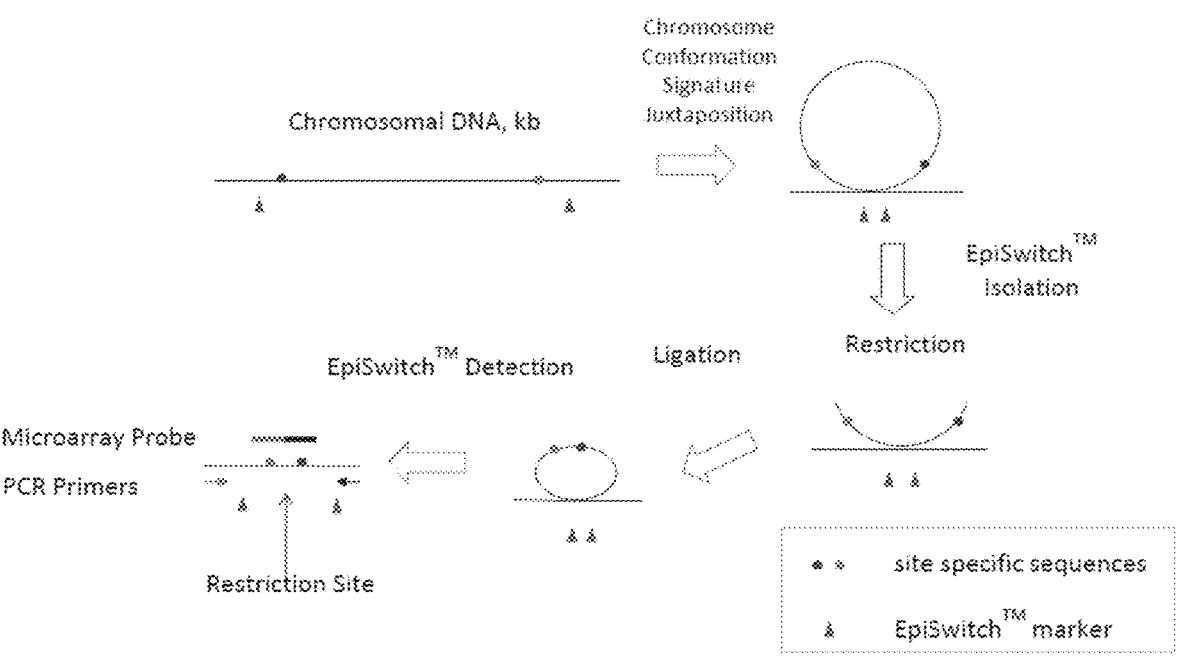
<u>Figure 10</u>

Figure 11:
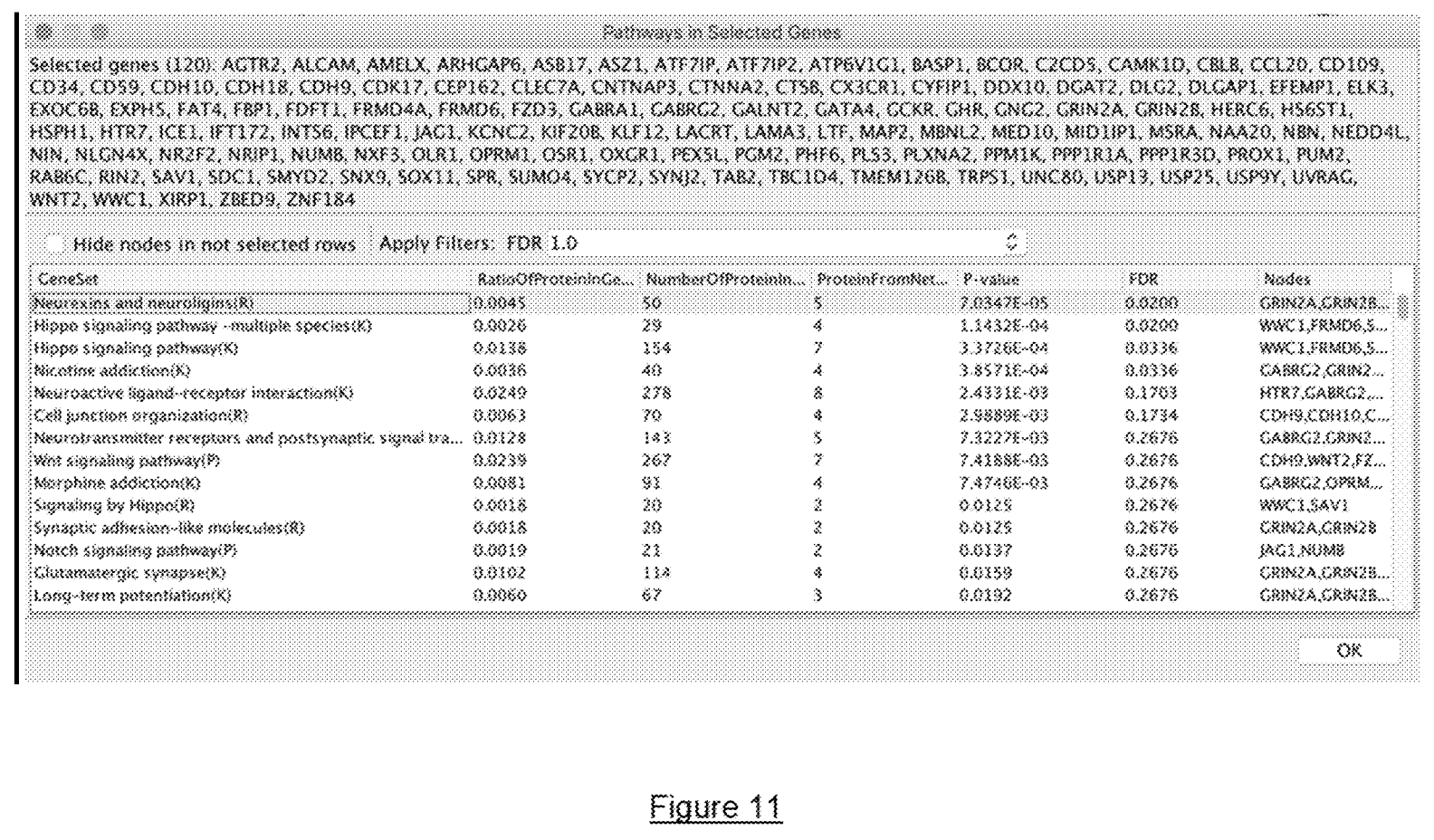

Pathways in Selected Genes

Selected genes (120): AGTR2, ALCAM, AMELX, ARHGAP6, ASB17, ASZ1, ATF7IP, ATF7IP2, ATP6V1G1, BASP1, BCOR, C2CD5, CAMK1D, CBLB, CCL20, CD109, CD34, CD59, CDH10, CDH18, CDH9, CDK17, CEP162, CLEC7A, CNTNAP3, CTNNA2, CT36, CX3CR1, CYFIP1, DDX10, DGAT2, DLG2, DLGAP1, EFEMP1, ELK3, EXOC6B, EXPH5, FAT4, FBP1, FDFT1, FRMD4A, FRMD6, FZD3, GABRA1, GABRG2, GALNT2, GATA4, GCKR, GHR, GNC2, GRIN2A, GRIN2B, HERC6, HS6ST1, HSPH1, HTR7, ICE1, IFT172, INT56, IPCEF1, JAC1, KCNC2, KIF20B, KLF12, LACRT, LAMA3, LTT, MAP2, MBNL2, MED10, MID1IP1, MSRA, NAA20, NBN, NEDD4L, NIN, NLGN4X, NRJF2, NRIP1, NUMB, NXF3, OLR1, OPRM1, OSR1, OXCR1, PEX5L, PGM2, PHF6, PLS3, PLXNA2, PPM1K, PPP1R3D, PROX1, PUM2, RAB3C, RIN2, SAV1, SDC1, SRXD2, SNX9, SOX11, SPR, SUMO4, SYCP2, SYNJ2, TAB2, TBC1D4, TMEM126B, TRPS1, UNC80, USP13, USP25, USP9Y, UVRAG, WNT2, WWC1, XIRP1, ZBED9, ZNF184

☑ Hide nodes in not selected rows    Apply filters: FDR 1.0

| GeneSet | RatioOfProteinsInCa... | NumberOfProteinsInCa... | ProteinFromNet... | P-value | FDR | Nodes |
|---|---|---|---|---|---|---|
| Neurexins and neuroligins(R) | 0.3845 | 50 | 5 | 7.0347E-05 | 0.0200 | GRIN2A,GRIN2B... |
| Hippo signaling pathway - multiple species(K) | 0.0026 | 29 | 4 | 1.1432E-04 | 0.0209 | WWC1,FRMD6,S... |
| Hippo signaling pathway(K) | 0.0138 | 154 | 7 | 3.3736E-04 | 0.0336 | WWC1,FRMD6,S... |
| Nicotine addiction(K) | 0.0036 | 40 | 4 | 3.8571E-04 | 0.0336 | GABRG2,GRIN2... |
| Neuroactive ligand-receptor interaction(K) | 0.0249 | 278 | 8 | 2.4331E-03 | 0.1703 | HTR7,GABRG2... |
| Cell junction organization(R) | 0.0063 | 70 | 4 | 2.9889E-03 | 0.1734 | CDH9,CDH10,C... |
| Neurotransmitter receptors and postsynaptic signal tra... | 0.0128 | 143 | 5 | 7.3227E-03 | 0.2676 | GABRG2,GRIN2... |
| Wnt signaling pathway(P) | 0.0239 | 267 | 7 | 7.4188E-03 | 0.2676 | CDH9,WNT2,FZ... |
| Morphine addiction(K) | 0.0081 | 91 | 4 | 7.4746E-03 | 0.2676 | GABRG2,OPRM... |
| Signaling by Hippo(R) | 0.0018 | 20 | 2 | 0.0125 | 0.2676 | WWC1,SAV1 |
| Synaptic adhesion-like molecules(R) | 0.0018 | 20 | 2 | 0.0125 | 0.2676 | GRIN2A,GRIN2B |
| Notch signaling pathway(P) | 0.0019 | 21 | 2 | 0.0137 | 0.2676 | JAG1,NUMB |
| Glutamatergic synapse(K) | 0.0102 | 114 | 4 | 0.0159 | 0.2676 | GRIN2A,GRIN2B... |
| Long-term potentiation(K) | 0.0060 | 67 | 3 | 0.0192 | 0.2676 | GRIN2A,GRIN2B... |

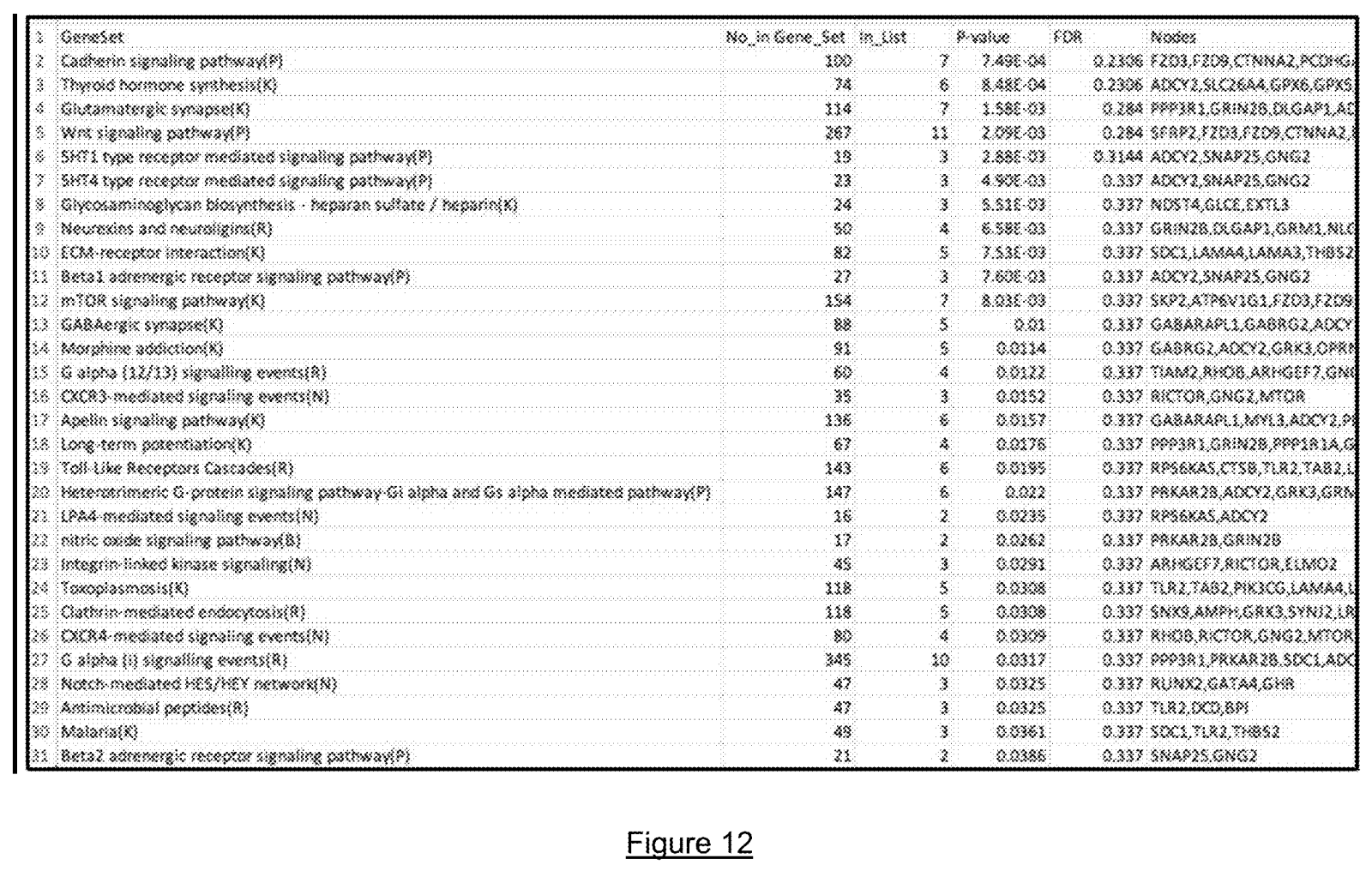

| | GeneSet | No_in_Gene_Set | in_List | P-value | FDR | Nodes |
|---|---|---|---|---|---|---|
| 1 | Cadherin signaling pathway(P) | 100 | 7 | 7.46E-04 | 0.1086 | FZD3,FZD9,CTNNA2,PCDHG... |
| 2 | Thyroid hormone synthesis(K) | 74 | 6 | 8.48E-04 | 0.2086 | ADCY2,SLC26A4,GPR6,GPR5 |
| 3 | Glutamatergic synapse(K) | 114 | 7 | 1.58E-03 | 0.284 | PPP3R1,GRIN3B,DLGAP1,AD... |
| 4 | Wnt signaling pathway(P) | 367 | 11 | 2.09E-03 | 0.284 | SFRP2,FZD3,FZD9,CTNNA2... |
| 5 | 5HT1 type receptor mediated signaling pathway(P) | 19 | 3 | 2.88E-03 | 0.3144 | ADCY2,SNAP25,GNG2 |
| 6 | 5HT4 type receptor mediated signaling pathway(P) | 23 | 3 | 4.99E-03 | 0.337 | ADCY2,SNAP25,GNG2 |
| 7 | Glycosaminoglycan biosynthesis - heparan sulfate / heparin(K) | 24 | 3 | 5.51E-03 | 0.337 | NDST4,GLCE,EXT3 |
| 8 | Neurexins and neuroligins(R) | 50 | 4 | 6.98E-03 | 0.337 | GRIN3B,DLGAP1,GRM1,NR... |
| 9 | ECR receptor interaction(R) | 82 | 5 | 7.51E-03 | 0.337 | SDC1,LAMA4,LAMA3,THBS2 |
| 10 | Beta 1 adrenergic receptor signaling pathway(P) | 27 | 3 | 7.66E-03 | 0.337 | ADCY2,SNAP25,GNG2 |
| 11 | mTOR signaling pathway(K) | 154 | 7 | 8.03E-03 | 0.337 | SKP2,ATP6V1C1,FZD3,FZD9 |
| 12 | GABAergic synapse(K) | 88 | 5 | 0.01 | 0.337 | GABRG2,ADCY2,GRK1,OPRM... |
| 13 | Morphine addiction(K) | 91 | 5 | 0.0114 | 0.337 | GABRA4,AP1,GABRG2,GRK1,OPRM... |
| 14 | G alpha (12/13) signalling events(R) | 69 | 4 | 0.0222 | 0.337 | TIAM2,RHOB,ARHGEF7,GN... |
| 15 | CXCR3-mediated signaling events(N) | 35 | 3 | 0.0252 | 0.337 | RICTOR,GNG2,MTOR |
| 16 | Apelin signaling pathway(K) | 136 | 6 | 0.0257 | 0.337 | GABRA4,AP1,MYL3,ADCY2,P... |
| 17 | Long term potentiation(K) | 67 | 4 | 0.0276 | 0.337 | PPP3R1,GRIN2B,PPP1R1A,... |
| 18 | Toll-Like Receptors Cascades(R) | 143 | 6 | 0.0295 | 0.337 | RPS6KA5,CTSB,TLR2,TAB1,... |
| 19 | Heterotrimeric G protein signaling pathway-Gi alpha and Gs alpha mediated pathway(P) | 147 | 6 | 0.021 | 0.337 | PRKAR2B,ADCY2,GRK3,GPR... |
| 20 | LPA4-mediated signaling events(N) | 16 | 2 | 0.0295 | 0.337 | RPS6KA5,ADCY2 |
| 21 | nitric oxide signaling pathway(R) | 17 | 2 | 0.0261 | 0.337 | PRKAR2B,GRIN2B |
| 22 | Integrin-linked kinase signaling(M) | 45 | 3 | 0.0291 | 0.337 | ARHGEF7,RICTOR,ELMO1 |
| 23 | Toxoplasmosis(K) | 118 | 5 | 0.0308 | 0.337 | TLR2,TAB2,PIK3CG,LAMA4,... |
| 24 | Clathrin-mediated endocytosis(R) | 118 | 5 | 0.0308 | 0.337 | SNX9,AMPH,GRK3,SYNJ2,LR... |
| 25 | DSCR4-mediated signaling events(N) | 80 | 4 | 0.0309 | 0.337 | RHOB,RICTOR,GNG2,MTOR |
| 26 | G alpha (i) signalling events(R) | 345 | 10 | 0.0317 | 0.337 | PPP3R1,PRKAR2B,SDC1,ADC... |
| 27 | Notch-mediated HES/HEY network(N) | 47 | 3 | 0.0325 | 0.337 | RUNX2,GATA4,Gli3 |
| 28 | Antimicrobial peptides(R) | 49 | 3 | 0.0325 | 0.337 | TLR2,DCD,BPI |
| 30 | Malaria(K) | 49 | 3 | 0.0361 | 0.337 | SDC1,TLR2,THBS2 |
| 31 | Beta2 adrenergic receptor signaling pathway(P) | 21 | 2 | 0.0386 | 0.337 | SNAP25,GNG2 |

Figure 12

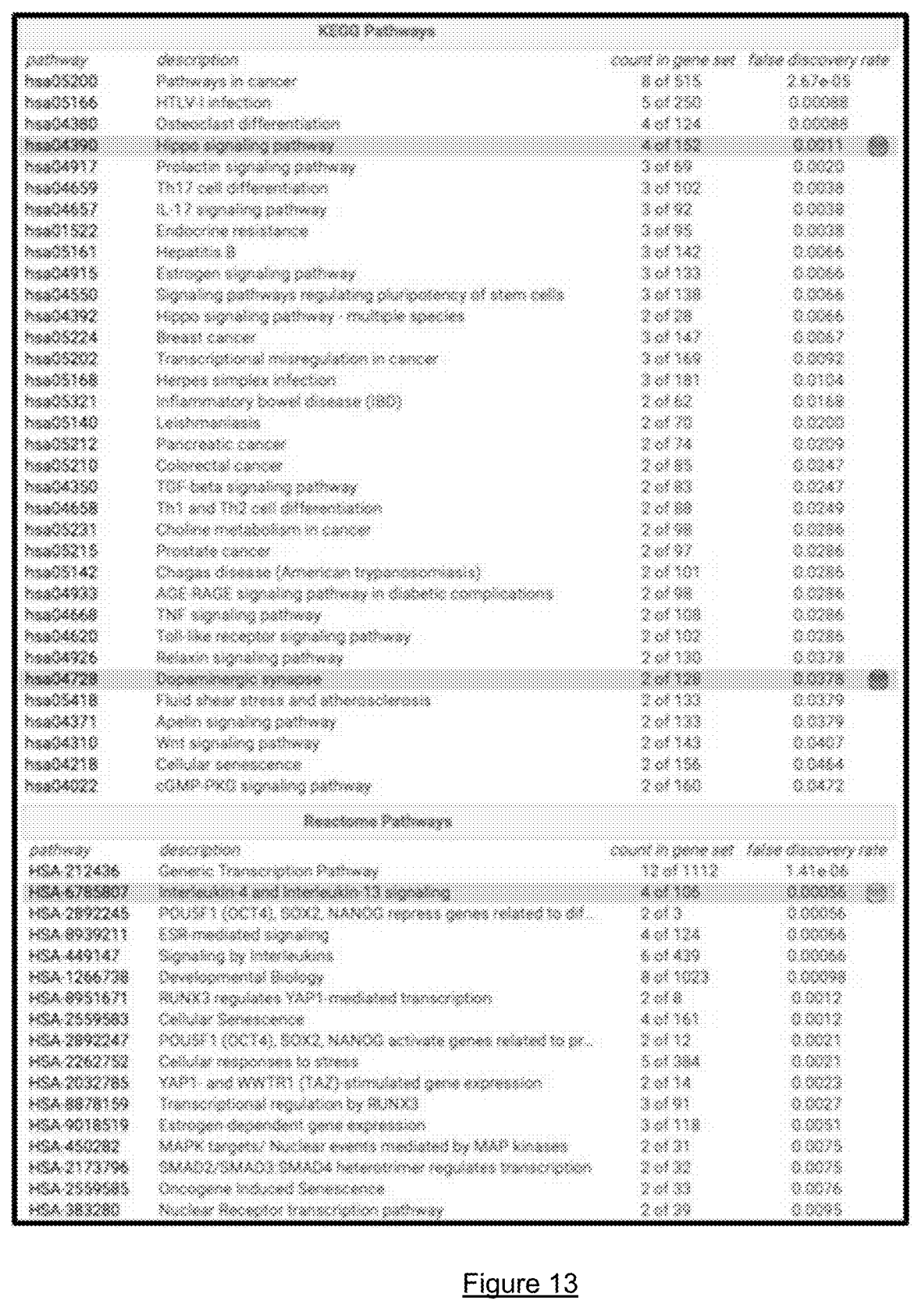

KEGG Pathways

| pathway | description | count in gene set | false discovery rate |
|---|---|---|---|
| hsa05200 | Pathways in cancer | 8 of 515 | 2.67e-05 |
| hsa05166 | HTLV-I infection | 5 of 250 | 0.0008 |
| hsa04380 | Osteoclast differentiation | 4 of 124 | 0.0008 |
| hsa04390 | Hippo signaling pathway | 4 of 150 | 0.0011 |
| hsa04917 | Prolactin signaling pathway | 3 of 69 | 0.0028 |
| hsa04659 | Th17 cell differentiation | 3 of 102 | 0.0038 |
| hsa04657 | IL-17 signaling pathway | 3 of 92 | 0.0038 |
| hsa01522 | Endocrine resistance | 3 of 95 | 0.0038 |
| hsa05161 | Hepatitis B | 3 of 142 | 0.0066 |
| hsa04915 | Estrogen signaling pathway | 3 of 133 | 0.0066 |
| hsa04550 | Signaling pathways regulating pluripotency of stem cells | 3 of 139 | 0.0066 |
| hsa04392 | Hippo signaling pathway - multiple species | 2 of 29 | 0.0066 |
| hsa05224 | Breast cancer | 3 of 147 | 0.0067 |
| hsa05202 | Transcriptional misregulation in cancer | 3 of 169 | 0.0093 |
| hsa05168 | Herpes simplex infection | 3 of 181 | 0.0104 |
| hsa05321 | Inflammatory bowel disease (IBD) | 2 of 62 | 0.0168 |
| hsa05140 | Leishmaniasis | 2 of 73 | 0.0208 |
| hsa05212 | Pancreatic cancer | 2 of 74 | 0.0209 |
| hsa05210 | Colorectal cancer | 2 of 85 | 0.0247 |
| hsa04350 | TGF-beta signaling pathway | 2 of 83 | 0.0247 |
| hsa04658 | Th1 and Th2 cell differentiation | 2 of 88 | 0.0249 |
| hsa05231 | Choline metabolism in cancer | 2 of 98 | 0.0286 |
| hsa05215 | Prostate cancer | 2 of 97 | 0.0286 |
| hsa05142 | Chagas disease (American trypanosomiasis) | 2 of 101 | 0.0286 |
| hsa04933 | AGE-RAGE signaling pathway in diabetic complications | 2 of 98 | 0.0286 |
| hsa04668 | TNF signaling pathway | 2 of 108 | 0.0286 |
| hsa04620 | Toll-like receptor signaling pathway | 2 of 102 | 0.0286 |
| hsa04926 | Relaxin signaling pathway | 2 of 130 | 0.0378 |
| hsa04720 | ... | 2 of 135 | 0.0378 |
| hsa05418 | Fluid shear stress and atherosclerosis | 2 of 133 | 0.0379 |
| hsa04371 | Apelin signaling pathway | 2 of 133 | 0.0379 |
| hsa04310 | Wnt signaling pathway | 2 of 143 | 0.0407 |
| hsa04218 | Cellular senescence | 2 of 156 | 0.0464 |
| hsa04022 | cGMP-PKG signaling pathway | 2 of 160 | 0.0472 |

Reactome Pathways

| pathway | description | count in gene set | false discovery rate |
|---|---|---|---|
| HSA-212436 | Generic Transcription Pathway | 12 of 1112 | 1.41e-06 |
| HSA-6785807 | Interleukin-4 and Interleukin-13 signaling | 4 of 108 | 0.00066 |
| HSA-2892245 | POU5F1 (OCT4), SOX2, NANOG repress genes related to dif... | 2 of 3 | 0.00066 |
| HSA-8939211 | ESR-mediated signaling | 4 of 124 | 0.00066 |
| HSA-449147 | Signaling by Interleukins | 6 of 439 | 0.00066 |
| HSA-1266738 | Developmental Biology | 8 of 1023 | 0.00098 |
| HSA-8951671 | RUNX3 regulates YAP1-mediated transcription | 2 of 8 | 0.0012 |
| HSA-2559583 | Cellular Senescence | 4 of 161 | 0.0012 |
| HSA-2892247 | POU5F1 (OCT4), SOX2, NANOG activate genes related to pr... | 2 of 12 | 0.0021 |
| HSA-2262752 | Cellular responses to stress | 5 of 384 | 0.0021 |
| HSA-2032785 | YAP1- and WWTR1 (TAZ) stimulated gene expression | 2 of 14 | 0.0023 |
| HSA-8878159 | Transcriptional regulation by RUNX3 | 3 of 91 | 0.0027 |
| HSA-9018519 | Estrogen-dependent gene expression | 3 of 118 | 0.0061 |
| HSA-450282 | MAPK targets/ Nuclear events mediated by MAP kinases | 2 of 31 | 0.0075 |
| HSA-2173796 | SMAD2/SMAD3:SMAD4 heterotrimer regulates transcription | 2 of 32 | 0.0075 |
| HSA-2559585 | Oncogene Induced Senescence | 2 of 33 | 0.0076 |
| HSA-383280 | Nuclear Receptor transcription pathway | 2 of 39 | 0.0093 |

Figure 13

| | GeneSet | No_In_Gene_Set | In_List | P-value | FDR | Nodes | |
|---|---|---|---|---|---|---|---|
| 1 | | | | | | | |
| 2 | Pathways in cancer(K) | 397 | 19 | 2.04E-05 | 0.0119 | C8L8,FZD3,F | |
| 3 | Huma papillomavirus infection(K) | 313 | 15 | 1.55E-04 | 0.0453 | FZD3,FZD9,C | |
| 4 | Basal cell carcinoma(K) | 55 | 6 | 2.70E-04 | 0.0537 | FZD3,FZD9,G | |
| 5 | PI3K-Akt signaling pathway(K) | 341 | 15 | 3.82E-04 | 0.0557 | COL9A1,SGK | |
| 6 | Toxoplasmosis(K) | 118 | 8 | 6.46E-04 | 0.0755 | IL12B,IFNGR | |
| 7 | Insulin Pathway(N) | 45 | 5 | 8.12E-04 | 0.0788 | RAPGEF1,SG | |
| 8 | G alpha (i) signalling events(R) | 345 | 14 | 1.29E-03 | 0.1067 | GPR183,SDC | |
| 9 | ECM-receptor interaction(K) | 82 | 6 | 2.10E-03 | 0.1444 | COL9A1,SDC | |
| 10 | IL8- and CXCR2-mediated signaling events(N) | 34 | 4 | 2.22E-03 | 0.1444 | PLCB1,ELMO | |
| 11 | Protein repair(R) | 5 | 2 | 2.95E-03 | 0.1713 | MSRA,MSRB | |
| 12 | 5HT1 type receptor mediated signaling pathway(P) | 19 | 3 | 3.57E-03 | 0.1744 | ADCY2,SNAP | |
| 13 | Class I MHC mediated antigen processing & presentation(R) | 191 | 9 | 3.63E-03 | 0.1744 | HERC5,PSME | |
| 14 | Focal adhesion(K) | 201 | 9 | 5.04E-03 | 0.1885 | COL9A1,RAP | |
| 15 | Proteoglycans in cancer(K) | 205 | 9 | 5.70E-03 | 0.1885 | C8L8,IL12B,F | |
| 16 | Melanogenesis(K) | 101 | 6 | 5.74E-03 | 0.1885 | FZD3,FZD9,P | |
| 17 | agrin in postsynaptic differentiation(B) | 45 | 4 | 5.96E-03 | 0.1885 | ARHGEF7,PA | |
| 18 | NOD-like receptor signaling pathway(K) | 170 | 8 | 6.03E-03 | 0.1885 | GABARAPL1, | |
| 19 | 5HT4 type receptor mediated signaling pathway(P) | 23 | 3 | 6.05E-03 | 0.1885 | ADCY2,SNAP | |
| 20 | Measles(K) | 136 | 7 | 6.28E-03 | 0.1885 | C8L8,IL12B,I | |
| 21 | TGF-beta receptor signaling(N) | 47 | 4 | 6.93E-03 | 0.2009 | NEDD4L,FKB | |
| 22 | Wnt signaling pathway(K) | 143 | 7 | 8.15E-03 | 0.2062 | SFRP5,FZD3, | |
| 23 | Alzheimer disease-presenilin pathway(P) | 111 | 6 | 8.90E-03 | 0.2062 | FZD3,FZD9,C | |
| 24 | Signaling by PDGF(R) | 51 | 4 | 9.15E-03 | 0.2062 | COL9A1,RAP | |
| 25 | Beta-catenin independent WNT signaling(R) | 112 | 6 | 9.27E-03 | 0.2062 | PSMD6,FZD3 | |
| 26 | Beta1 adrenergic receptor signaling pathway(P) | 27 | 3 | 9.35E-03 | 0.2062 | ADCY2,SNAP | |
| 27 | Translocation of GLUT4 to the plasma membrane(R) | 52 | 4 | 9.77E-03 | 0.2062 | RHOQ,EXOC | |
| 28 | Wnt signaling network(N) | 28 | 3 | 0.0103 | 0.2062 | FZD9,WNT2, | |
| 29 | IL8- and CXCR1-mediated signaling events(N) | 28 | 3 | 0.0103 | 0.2062 | PLCB1,PDPK1 | |
| 30 | Hedgehog signaling pathway(P) | 10 | 2 | 0.0112 | 0.2244 | GLI3,SHH | |
| 31 | mTOR signaling pathway(K) | 154 | 7 | 0.0119 | 0.2257 | ATP6V1E2,F | |

| | GeneSet | No_Gene_Set | From_list | P-value | FDR | Nodes |
|---|---|---|---|---|---|---|
| 2 | ras-independent pathway in nk cell-mediated cytotoxicity(B) | 23 | 6 | 1.86E-05 | 0.0166 | PIK3R1,KLRC1,KLRC2,KLRC3,KLRD1 |
| 3 | Jak-STAT signaling pathway(K) | 158 | 10 | 7.66E-05 | 0.035 | PIK3R1,IFNGR1,OSMR,CRLF2,IL13RA1,IL4R,IFR,IL6ST,CSF2RA,PTPN2 |
| 4 | Natural killer cell mediated cytotoxicity(K) | 135 | 9 | 1.20E-04 | 0.0259 | PIK3R1,KLRK1,PPP3CC,VAV3,IFNGR1,KLRC1,KLRC2,KLRC3,KLRD1 |
| 5 | Aldosterone-regulated sodium reabsorption(K) | 39 | 5 | 2.26E-04 | 0.0369 | NEDD4L,PIK3R1,SGK1,SCNN1G,SCNN1B |
| 6 | DAP12 interactions(R) | 44 | 5 | 3.91E-04 | 0.0426 | PIK3R1,KLRK1,VAV3,KLRC2,KLRD1 |
| 7 | Oxytocin signaling pathway(K) | 159 | 9 | 3.95E-04 | 0.0426 | MEF2C,PIK3R1,PIK3R1,JUN,RYR3,PPP3CC,ADCY2,PTGS2,PLA2G4A,CACNG2 |
| 8 | Signaling events mediated by Hepatocyte Growth Factor Receptor (c-Met)(N) | 80 | 6 | 9.12E-04 | 0.0848 | RIN2,PIK3R1,JUN,CTNNB1,DEPTOR,PTPN2 |
| 9 | Cytokine-cytokine receptor interaction(K) | 265 | 11 | 1.19E-03 | 0.0967 | IFNGR1,OSMR,CRLF2,CCL4L1,IL13RA1,IL4R,IFR,IL6ST,CCL3L3,CSF2RA,PL... |
| 10 | mTOR signaling pathway(K) | 154 | 8 | 1.43E-03 | 0.0967 | ATP6V1G1,SGK1,PIK3R1,FZD3,FZD9,SGK1,RICTOR,DEPTOR |
| 11 | Signaling mediated by p38-alpha and p38-beta(N) | 35 | 4 | 1.46E-03 | 0.0967 | MEF2C,JUN,PTGS2,PLA2G4A |
| 12 | MAPK signaling pathway(K) | 255 | 10 | 2.98E-03 | 0.1613 | MEF2C,JUN,GADD45G,PPP3CC,MECOM,MAP4K3,MAP3K8,CACNA1E,PI... |
| 13 | Metabotropic glutamate receptor group III pathway(P) | 6 | 2 | 3.21E-03 | 0.1613 | GRIN2A,SNAP29 |
| 14 | Pathways in cancer(K) | 397 | 13 | 3.53E-03 | 0.1613 | PIK3R1,FZD3,JUN,FZD9,MECOM,ADCY2,PTGS2,ARNT2,CTNNB1,COL4A... |
| 15 | Signaling pathways regulating pluripotency of stem cells(K) | 142 | 7 | 3.74E-03 | 0.1613 | PIK3R1,FZD3,FZD9,CTNNB1,IFR,IL6ST,MEIS1 |
| 16 | Interleukin-6 family signaling(R) | 23 | 3 | 4.12E-03 | 0.1613 | OSMR,IFR,IL6ST |
| 17 | Ion channel transport(R) | 145 | 7 | 4.18E-03 | 0.1613 | ATP6V1G1,NEDD4L,RYR3,SGK1,SCNN1G,SCNN1B,TRPV4 |
| 18 | Presynaptic depolarization and calcium channel opening(R) | 7 | 2 | 4.33E-03 | 0.1613 | CACNA1E,CACNG2 |
| 19 | Antigen processing and presentation(K) | 77 | 5 | 4.48E-03 | 0.1613 | KLRC1,KLRC2,KLRC3,KLRC4,KLRD1 |
| 20 | Ovarian steroidogenesis(K) | 50 | 4 | 5.29E-03 | 0.1798 | CYP1B1,ADCY2,PTGS2,PLA2G4A |
| 21 | Calcium signaling in the CD4+ TCR pathway(N) | 27 | 3 | 6.40E-03 | 0.1943 | JUN,AKAP5,PTGS2 |
| 22 | Small cell lung cancer(K) | 86 | 5 | 7.06E-03 | 0.1943 | PIK3R1,PTGS2,COL4A2,COL4A1,TRAF5 |
| 23 | Salmonella infection(K) | 86 | 5 | 7.06E-03 | 0.1943 | JUN,IFNGR1,DYNC1I1,CCL4L1,CCL3L3 |
| 24 | Reelin signaling pathway(N) | 28 | 3 | 7.07E-03 | 0.1943 | PIK3R1,GRIN2A,DAB1 |
| 25 | Huntington disease(P) | 121 | 6 | 7.19E-03 | 0.1941 | CYP1P2,GRIN2A,JUN,GRIK1,DYNC1I1,CAPN2 |
| 26 | Osteopontin-mediated events(N) | 29 | 3 | 7.77E-03 | 0.1953 | PIK3R1,JUN,VAV3 |
| 27 | Regulation of lipolysis in adipocytes(K) | 56 | 4 | 7.81E-03 | 0.1953 | PIK3R1,ADCY2,PTGS2,ADRB2 |
| 28 | Signaling events mediated by focal adhesion kinase(N) | 60 | 4 | 9.87E-03 | 0.2296 | PIK3R1,JUN,CAPN2,ELMO1 |
| 29 | Signaling by VEGF(R) | 94 | 5 | 0.0101 | 0.2296 | CYP1P2,PIK3R1,VAV3,RICTOR,ELMO1 |
| 30 | VEGF signaling pathway(K) | 61 | 4 | 0.0104 | 0.2296 | PIK3R1,PPP3CC,PTGS2,PLA2G4A |
| 31 | IL4-mediated signaling events(N) | 64 | 4 | 0.0123 | 0.2308 | PIK3R1,IL13RA1,IL4R,OPRM1 |
| 32 | mTOR signaling pathway(N) | 64 | 4 | 0.0133 | 0.2308 | SGK1,RICTOR,DEPTOR,PDCD4 |

Figure 16

| | GeneSet | No_Gene_Set | From_list | P-value | FDR | Nodes |
|---|---|---|---|---|---|---|
| 1 | ras-independent pathway in nk cell mediated cytotoxicity(B) | 25 | 5 | 2.66E-05 | 0.5186 | PIK3R1,KLRC1,KLRC2,KLRC3,KLRD1 |
| 2 | jak STAT signaling pathway(K) | 158 | 10 | 7.66E-05 | 0.025 | PIK3R1,IFNGR1,OSMR,CRLF2,IL13RA1,IL4R,LIFR,IL6ST,CSF2RA,PTPN2 |
| 3 | Natural killer cell mediated cytotoxicity(K) | 135 | 9 | 1.20E-04 | 0.0258 | PIK3R1,KLRK1,PPP3CC,VAV3,IFNGR1,KLRC1,KLRC2,KLRC3,KLRD1 |
| 4 | Aldosterone-regulated sodium reabsorption(K) | 39 | 5 | 2.26E-04 | 0.0369 | NEDD4L,PIK3R1,SGK1,SCNN1G,SCNN1B |
| 5 | DAP12 interactions(R) | 44 | 5 | 3.91E-04 | 0.0426 | PIK3R1,KLRK1,VAV3,KLRC2,KLRD1 |
| 6 | Oxytocin signaling pathway(K) | 159 | 9 | 3.99E-04 | 0.0426 | MEF2C,PIK3R1,JUN,RYR3,PPP3CC,ADCY2,PTGS2,PLA2G4A,CACNG2 |
| 7 | Signaling events mediated by Hepatocyte Growth Factor Receptor (c-Met)(N) | 80 | 6 | 9.13E-04 | 0.0848 | RIN2,PIK3R1,JUN,CTNNB1,DEPTOR,PTPN2 |
| 8 | Cytokine-cytokine receptor interaction(K) | 265 | 11 | 1.19E-03 | 0.0967 | IFNGR1,OSMR,CRLF2,CCL4L1,IL13RA1,IL4R,LIFR,IL6ST,CCL3L3,CSF2RA... |
| 9 | mTOR signaling pathway(R) | 154 | 8 | 1.43E-03 | 0.0967 | ATP6V1G1,SEH1L,PIK3R1,FZD9,FZD3,SGK1,RICTOR,DEPTOR |
| 10 | Signaling mediated by p38-alpha and p38-beta(N) | 35 | 4 | 1.49E-03 | 0.0967 | MEF2C,JUN,PTGS2,PLA2G4A |
| 11 | rAAPK signaling pathway(K) | 255 | 10 | 2.98E-03 | 0.1613 | MEF2C,JUN,GADD45G,PPP3CC,RAECOM,RAECOM,MAP4K3,MAP3K8,CACNA1E,PL... |
| 12 | Metabotropic glutamate receptor group III pathway(P) | 6 | 2 | 3.21E-03 | 0.1613 | GRIN2A,SNAP29 |
| 13 | Pathways in cancer(K) | 397 | 13 | 3.53E-03 | 0.1613 | PIK3R1,FZD3,JUN,FZD9,RAECOM,ADCY2,PTGS2,ARNT2,CTNNB1,COL4A... |
| 14 | Signaling pathways regulating pluripotency of stem cells(K) | 142 | 7 | 3.74E-03 | 0.1613 | PIK3R1,FZD3,FZD9,CTNNB1,LIFR,IL6ST,MEIS1 |
| 15 | Interleukin-6 family signaling(R) | 23 | 3 | 4.12E-03 | 0.1613 | OSMR,LIFR,IL6ST |
| 16 | Ion channel transport(R) | 145 | 7 | 4.18E-03 | 0.1613 | ATP6V1G1,NEDD4L,RYR3,SGK1,SCNN1G,SCNN1B,TRPV4 |
| 17 | Presynaptic depolarization and calcium channel opening(R) | 7 | 3 | 4.33E-03 | 0.1613 | CACNA1E,CACNG2 |
| 18 | Antigen processing and presentation(K) | 77 | 5 | 4.48E-03 | 0.1613 | KLRC1,KLRC2,KLRC3,KLRC4,KLRD1 |
| 19 | Ovarian steroidogenesis(K) | 50 | 4 | 5.29E-03 | 0.1798 | CYP1B1,ADCY2,PTGS2,PLA2G4A |
| 20 | Calcium signaling in the CD4+ TCR pathway(N) | 27 | 3 | 6.40E-03 | 0.1941 | JUN,AKAP5,PTGS2 |
| 21 | Small cell lung cancer(K) | 86 | 5 | 7.06E-03 | 0.1941 | PIK3R1,PTGS2,COL4A2,COL4A1,TRAF5 |
| 22 | Salmonella infection(K) | 86 | 5 | 7.06E-03 | 0.1941 | JUN,IFNGR1,DYNC1I3,COL4L1,CCL3L3 |
| 23 | Reelin signaling pathway(N) | 28 | 3 | 7.07E-03 | 0.1941 | PIK3R1,GRIN2A,DAB1 |
| 24 | Huntington disease(P) | 122 | 6 | 7.19E-03 | 0.1941 | CYFIP2,GRIN2A,JUN,GRIK1,DYNC1I3,CAPN2 |
| 25 | Osteopontin-mediated events(N) | 29 | 3 | 7.77E-03 | 0.1953 | PIK3R1,JUN,VAV3 |
| 26 | Regulation of lipolysis in adipocytes(K) | 56 | 4 | 7.81E-03 | 0.1953 | PIK3R1,ADCY2,PTGS2,AQMR2 |
| 27 | Signaling events mediated by focal adhesion kinase(N) | 60 | 4 | 9.87E-03 | 0.2286 | PIK3R1,JUN,CAPN2,ELMO1 |
| 28 | Signaling by VEGF(R) | 94 | 5 | 0.0101 | 0.2286 | CYFIP2,PIK3R1,VAV3,RICTOR,ELMO1 |
| 29 | VEGF signaling pathway(K) | 61 | 4 | 0.0104 | 0.2286 | PIK3R1,PPP3CC,PTGS2,PLA2G4A |
| 30 | IL4-mediated signaling events(N) | 64 | 4 | 0.0123 | 0.2308 | PIK3R1,IL13RA1,IL4R,GPRM1 |
| 31 | mTOR signaling pathway(N) | 64 | 4 | 0.0123 | 0.2308 | SGK1,RICTOR,DEPTOR,PDCD4 |

Figure 17

KEGG Pathways

| pathway | description | count in gene set | false discovery rate |
|---|---|---|---|
| hsa05202 | Transcriptional misregulation in cancer | 7 of 169 | 3.86e-07 |
| hsa05221 | Acute myeloid leukemia | 3 of 66 | 0.0043 |
| hsa05166 | HTLV-I infection | 4 of 259 | 0.0104 |
| hsa05200 | Pathways in cancer | 5 of 515 | 0.0143 |
| hsa05161 | Hepatitis B | 3 of 142 | 0.0143 |
| hsa04550 | Signaling pathways regulating pluripotency of stem cells | 3 of 138 | 0.0143 |
| | | | (less ...) |

Reactome Pathways

| pathway | description | count in gene set | false discovery rate |
|---|---|---|---|
| HSA-9006931 | Signaling by Nuclear Receptors | 5 of 167 | 0.00061 |
| HSA-8866911 | TFAP2 (AP-2) family regulates transcription of cell cycle fac... | 2 of 6 | 0.00067 |
| HSA-8864260 | Transcriptional regulation by the AP-2 (TFAP2) family of tra... | 3 of 34 | 0.00067 |
| HSA-5617472 | Activation of anterior HOX genes in hindbrain development... | 4 of 91 | 0.00067 |
| HSA-383280 | Nuclear Receptor transcription pathway | 3 of 39 | 0.00067 |
| HSA-212436 | Generic Transcription Pathway | 9 of 1112 | 0.00067 |
| HSA-1266738 | Developmental Biology | 9 of 1023 | 0.00067 |
| HSA-8866910 | TFAP2 (AP-2) family regulates transcription of growth facto... | 2 of 11 | 0.0017 |
| HSA-8878171 | Transcriptional regulation by RUNX1 | 4 of 201 | 0.0022 |
| HSA-381340 | Transcriptional regulation of white adipocyte differentiation | 3 of 83 | 0.0024 |
| HSA-1362277 | Transcription of E2F targets under negative control by DRE... | 2 of 19 | 0.0035 |
| HSA-4090294 | SUMOylation of intracellular receptors | 2 of 23 | 0.0046 |
| HSA-9018519 | Estrogen-dependent gene expression | 3 of 118 | 0.0054 |
| HSA-375170 | CDO in myogenesis | 2 of 28 | 0.0055 |
| HSA-5362517 | Signaling by Retinoic Acid | 2 of 43 | 0.0107 |
| HSA-8943724 | Regulation of PTEN gene transcription | 2 of 59 | 0.0185 |
| HSA-1257604 | PIP3 activates AKT signaling | 3 of 242 | 0.0276 |
| HSA-69202 | Cyclin E associated events during G1/S transition | 2 of 80 | 0.0302 |
| HSA-69656 | Cyclin A:Cdk2 associated events at S phase entry | 2 of 82 | 0.0304 |
| HSA-2980736 | Peptide hormone metabolism | 2 of 84 | 0.0306 |
| HSA-8939236 | RUNX1 regulates transcription of genes involved in differen... | 2 of 96 | 0.0365 |
| HSA-6785807 | Interleukin-4 and interleukin-13 signaling | 2 of 108 | 0.0425 |

CHROMOSOME CONFORMATION MARKERS OF AUTISM SPECTRUM DISORDER

CROSS-REFERENCE

This application is a 371 National Stage filing and claims the benefit under 35 U.S.C. § 120 of International Application No. PCT/GB2020/052171, filed 10 Sep. 2020, which claims priority to U.S. Provisional Application No. 62/898,969, filed 11 Sep. 2019, each of which is incorporated herein by reference in its entirety.

SEQUENCE LISTING INCORPORATION BY REFERENCE

The application herein incorporates by reference in its entirety the sequence listing material in the ASCII text file named "ISALFSQL", created Feb. 22, 2022, and having the size of 24,248,320 bytes.

FIELD OF THE INVENTION

The invention relates to disease markers.

BACKGROUND OF THE INVENTION

Autism Spectrum Disorder (ASD) is believed to be associated with a combination of genetic and environmental factors. Risk factors may include certain infections, toxins, autoimmune diseases, cocaine and air pollutants. Globally, autism is estimated to affect 24.8 million people (estimate at 2015). In developed countries almost 1.5% of children are diagnosed with ASD (estimated at 2017). This rate has significantly increased from 0.7%, as estimated in 2000.

SUMMARY OF THE INVENTION

The invention is based on the finding that using chromosome conformation signatures to measure systemic significant differences in 3D genome architecture as detected in surrogate systemic profiling, one is able to identify disseminating individual chromosome conformations specific for autism spectrum disorder (ASD) and for different forms of ASD.

Accordingly, the invention provides a process for detecting a chromosome state which represents a subgroup in a population comprising determining whether a chromosome interaction relating to that chromosome state is present or absent within a defined region of the genome; and wherein said chromosome interaction has optionally been identified by a method of determining which chromosomal interactions are relevant to a chromosome state corresponding to the subgroup of the population, comprising contacting a first set of nucleic acids from subgroups with different states of the chromosome with a second set of index nucleic acids, and allowing complementary sequences to hybridise, wherein the nucleic acids in the first and second sets of nucleic acids represent a ligated product comprising sequences from both the chromosome regions that have come together in chromosomal interactions, and wherein the pattern of hybridisation between the first and second set of nucleic acids allows a determination of which chromosomal interactions are specific to the subgroup; and wherein the subgroup relates to prognosis for autism spectrum disorder (ASD) and the chromosome interaction:

(i) is present in any one of the regions or genes listed in any of Tables 1, 2, 3 or 4; and/or (ii) corresponds to any one of the chromosome interactions represented by any probe shown in any one of Tables 1, 2, 3 or 4, and/or (iii) is present in a 4,000 base region which comprises or which flanks (i) or (ii).

Further, the invention provides a process for identifying the prognosis to ASD comprising determining whether a chromosome interaction as represented in any one of Tables 1, 2, 3 or 4 is present or absent, to thereby determine the prognosis. In one aspect the invention provides a process for identifying the prognosis to ASD comprising determining whether a chromosome interaction as represented in any one of Tables 8, 9 or 10 is present or absent, to thereby determine the prognosis. The invention also provides a process for identifying prognosis to ASD comprising determining whether a chromosome interaction as represented by any one of the tables herein is present or absent, to thereby determine the prognosis.

DETAILED DESCRIPTION OF THE INVENTION

Aspects of the Invention

The invention concerns determining prognosis in ASD, including in respect to the severity and/or type of ASD is aggressive or indolent. This determining is by typing any of the relevant markers disclosed herein, for example in any of the Tables, or preferred combinations of markers, or markers in defined specific regions disclosed herein. Thus the invention relates to a method of typing an individual to determine the ASD status, for example to diagnose ASD or the type of ASD, or to determine prognosis for ASD or the type of ASD.

Essentially in the process of the invention subpopulations of ASD can be identified by typing of the markers. Therefore the invention, for example, concerns a panel of epigenetic markers which relates to prognosis ASD. The invention therefore allows personalised therapy to be given to the patient which accurately reflects the patient's needs. Any therapy, for example drug, which is mentioned herein may be administered to an individual based on the result of the typing. The process of the invention may thus be carried out to select an individual for a medical treatment.

Preferably the markers which are typed in the process are those represented by probe or primer sequences in the tables.

The Process of the Invention

The process of the invention comprises a typing system for detecting chromosome interactions relevant to prognosis. This typing may be performed using the EpiSwitch™ system mentioned herein which is based on cross-linking regions of chromosome which have come together in the chromosome interaction, subjecting the chromosomal DNA to cleavage and then ligating the nucleic acids present in the cross-linked entity to derive a ligated nucleic acid with sequence from both the regions which formed the chromosomal interaction. Detection of this ligated nucleic acid allows determination of the presence or absence of a particular chromosome interaction.

The chromosomal interactions may be identified using the above described method in which populations of first and second nucleic acids are used. These nucleic acids can also be generated using EpiSwitch™ technology.

The Epigenetic Interactions Relevant to the Invention

As used herein, the term 'epigenetic' and 'chromosome' interactions typically refer to interactions between distal regions of a chromosome, said interactions being dynamic and altering, forming or breaking depending upon the status of the region of the chromosome.

In particular processes of the invention chromosome interactions are typically detected by first generating a ligated nucleic acid that comprises sequence from both regions of the chromosomes that are part of the interactions. In such processes the regions can be cross-linked by any suitable means. In a preferred aspect, the interactions are cross-linked using formaldehyde, but may also be cross-linked by any aldehyde, or D-Biotinoyl-e-aminocaproic acid-N-hydroxysuccinimide ester or Digoxigenin-3-O-methylcarbonyl-e-aminocaproic acid-N-hydroxysuccinimide ester. Para-formaldehyde can cross link DNA chains which are 4 Angstroms apart. Preferably the chromosome interactions are on the same chromosome and optionally 2 to 10 Angstroms apart.

The chromosome interaction may reflect the status of the region of the chromosome, for example, if it is being transcribed or repressed in response to change of the physiological conditions. Chromosome interactions which are specific to subgroups as defined herein have been found to be stable, thus providing a reliable means of measuring the differences between the two subgroups.

In addition, chromosome interactions specific to a characteristic (such as prognosis) will normally occur early in a biological process, for example compared to other epigenetic markers such as methylation or changes to binding of histone proteins. Thus the process of the invention is able to detect early stages of a biological process. This allows early intervention (for example treatment) which may as a consequence be more effective. Chromosome interactions also reflect the current state of the individual and therefore can be used to assess changes to prognosis. Furthermore, there is little variation in the relevant chromosome interactions between individuals within the same subgroup. Detecting chromosome interactions is highly informative with up to 50 different possible interactions per gene, and so processes of the invention can interrogate 500,000 different interactions.

There is no one-to-one correspondence between chromosome interactions and genetic markers or other types of epigenetic markers, such as methylation. Chromosome interactions therefore represent a separate modality of regulation.

Preferred Marker Sets

Herein the term 'marker' or 'biomarker' refers to a specific chromosome interaction which can be detected (typed) in the invention. Specific markers are disclosed herein, any of which may be used in the invention. Further sets of markers may be used, for example in the combinations or numbers disclosed herein. The specific markers disclosed in the tables herein are preferred as well as markers presents in genes and regions mentioned in the tables herein are preferred. These may be typed by any suitable method, for example the PCR or probe based methods disclosed herein, including a qPCR method. The markers are defined herein by location or by probe and/or primer sequences.

Location and Causes of Chromosome Interactions

Chromosome interactions may overlap and include the regions of chromosomes shown to encode relevant or unde-scribed genes, but equally may be in intergenic regions. It should further be noted that the inventors have discovered that epigenetic interactions in all regions are equally important in determining the status of the chromosomal locus. These interactions are not necessarily in the coding region of a particular gene located at the locus and may be in intergenic regions.

The chromosome interactions which are detected in the invention could be impacted by changes to the underlying DNA sequence, by environmental factors, DNA methylation, non-coding antisense RNA transcripts, non-mutagenic carcinogens, histone modifications, chromatin remodelling and specific local DNA interactions. The changes which lead to the chromosome interactions may be impacted by changes to the underlying nucleic acid sequence, which themselves do not directly affect a gene product or the mode of gene expression. Such changes may be for example, SNPs within and/or outside of the genes, gene fusions and/or deletions of intergenic DNA, microRNA, and non-coding RNA. For example, it is known that roughly 20% of SNPs are in non-coding regions, and therefore the process as described is also informative in non-coding situation. In one aspect the regions of the chromosome which come together to form the interaction are less than 5 kb, 3 kb, 1 kb, 500 base pairs or 200 base pairs apart on the same chromosome.

The chromosome interaction which is detected is preferably within any of the genes mentioned in any of Tables 1, 2, 3 or 4. However it may also be upstream or downstream of the gene, for example up to 50,000, up to 30,000, up to 20,000, up to 10,000 or up to 5000 bases upstream or downstream from the gene or from the coding sequence.

Subgroups, Time Points and Personalised Treatment

In one aspect the present invention determines prognosis. This may be at one or more defined time points, for example at at least 1, 2, 5, 8 or 10 different time points. The durations between at least 1, 2, 5 or 8 of the time points may be at least 5, 10, 20, 50, 80 or 100 days.

As used herein, a "subgroup" preferably refers to a population subgroup, more preferably a subgroup in the population of a particular animal such as a particular eukaryote, or mammal (e.g. human, non-human, non-human primate, or rodent e.g. mouse or rat). Most preferably, a "subgroup" refers to a subgroup in the human population.

The invention includes detecting and treating particular subgroups in a population. The inventors have discovered that chromosome interactions differ between subsets (for example at least two subsets) in a given population. Identifying these differences will allow physicians to categorize their patients as a part of one subset of the population as described in the process. The invention therefore provides physicians with a process of personalizing medicine for the patient based on their epigenetic chromosome interactions, for example the type of drug and/or its dose and/or its frequency of administration.

The invention relates to any specific condition that comes within the broad definition of ASD. In one aspect the condition is autistic disorder or childhood autism. The condition may be Asperger's syndrome, PDD-NOS (Pervasive Development Disorder) or childhood disintegrative disorder. The invention relates to any PDD-NOS condition including an addictive condition, such as addiction to substances or digital media devices. ASD EpiSwitch markers reveal epigenetic deregulations and regulatory defects in addiction pathways, pathways of neuroxins and neuroligins regulation, estrogen signalling, TH17 differentiation and regullation of NK cells, Hippo, IL4 and IL13 regulation, HPV infection and mTOR signalling.

Generating Ligated Nucleic Acids

Certain aspects of the invention utilise ligated nucleic acids, in particular ligated DNA. These comprise sequences from both of the regions that come together in a chromosome interaction and therefore provide information about the interaction. The EpiSwitch™ method described herein uses generation of such ligated nucleic acids to detect chromosome interactions.

Thus a process of the invention may comprise a step of generating ligated nucleic acids (e.g. DNA) by the following steps (including a method comprising these steps):

(i) cross-linking of epigenetic chromosomal interactions present at the chromosomal locus, preferably in vitro;

(ii) optionally isolating the cross-linked DNA from said chromosomal locus;

(iii) subjecting said cross-linked DNA to cutting, for example by restriction digestion with an enzyme that cuts it at least once (in particular an enzyme that cuts at least once within said chromosomal locus);

(iv) ligating said cross-linked cleaved DNA ends (in particular to form DNA loops); and (v) optionally identifying the presence of said ligated DNA and/or said DNA loops, in particular using techniques such as PCR (polymerase chain reaction), to identify the presence of a specific chromosomal interaction.

These steps may be carried out to detect the chromosome interactions for any aspect mentioned herein. The steps may also be carried out to generate the first and/or second set of nucleic acids mentioned herein.

PCR (polymerase chain reaction) may be used to detect or identify the ligated nucleic acid, for example the size of the PCR product produced may be indicative of the specific chromosome interaction which is present, and may therefore be used to identify the status of the locus. In preferred aspects at least 1, 2 or 3 primers or primer pairs as shown in Table 5 are used in the PCR reaction. In other aspects at least 1, 10, 20, 30, 50 or 80 of the primers or primer pairs as shown in Table 1, 2, 3 or 4 are used in the PCR reaction. The skilled person will be aware of numerous restriction enzymes which can be used to cut the DNA within the chromosomal locus of interest. It will be apparent that the particular enzyme used will depend upon the locus studied and the sequence of the DNA located therein. A non-limiting example of a restriction enzyme which can be used to cut the DNA as described in the present invention is Taql.

EpiSwitch™ Technology

The EpiSwitch™ Technology also relates to the use of microarray EpiSwitch™ marker data in the detection of epigenetic chromosome conformation signatures specific for phenotypes. Aspects such as EpiSwitch™ which utilise ligated nucleic acids in the manner described herein have several advantages. They have a low level of stochastic noise, for example because the nucleic acid sequences from the first set of nucleic acids of the present invention either hybridise or fail to hybridise with the second set of nucleic acids. This provides a binary result permitting a relatively simple way to measure a complex mechanism at the epigenetic level. EpiSwitch™ technology also has fast processing time and low cost. In one aspect the processing time is 3 hours to 6 hours.

Samples and Sample Treatment

The process of the invention will normally be carried out on a sample. The sample may be obtained at a defined time point, for example at any time point defined herein. The sample will normally contain DNA from the individual. It will normally contain cells. In one aspect a sample is obtained by minimally invasive means, and may for example be a blood sample. DNA may be extracted and cut up with a standard restriction enzyme. This can pre-determine which chromosome conformations are retained and will be detected with the EpiSwitch™ platforms. Due to the synchronisation of chromosome interactions between tissues and blood, including horizontal transfer, a blood sample can be used to detect the chromosome interactions in tissues, such as tissues relevant to disease.

Properties of Nucleic Acids of the Invention

The invention relates to certain nucleic acids, such as the ligated nucleic acids which are described herein as being used or generated in the process of the invention. These may be the same as, or have any of the properties of, the first and second nucleic acids mentioned herein. The nucleic acids of the invention typically comprise two portions each comprising sequence from one of the two regions of the chromosome which come together in the chromosome interaction. Typically each portion is at least 8, 10, 15, 20, 30 or 40 nucleotides in length, for example 10 to 40 nucleotides in length. Preferred nucleic acids comprise sequence from any of the genes mentioned in any of the tables. Typically preferred nucleic acids comprise the specific probe sequences mentioned in Table 1, 2, 3 or 4; or fragments and/or homologues of such sequences.

Preferably the nucleic acids are DNA. It is understood that where a specific sequence is provided the invention may use the complementary sequence as required in the particular aspect. Preferably the nucleic acids are DNA. It is understood that where a specific sequence is provided the invention may use the complementary sequence as required in the particular aspect.

The primers shown in any of Tables 1, 2, 3 or 4 may also be used in the invention as mentioned herein. In one aspect primers are used which comprise any of: the sequences shown in Table 1, 2, 3 or 4; or fragments and/or homologues of any sequence shown in Table 1, 2, 3 or 4.

The 'First' and 'Second' Nucleic Acids

In one aspect of the invention:

the second set of nucleic acids is from a larger group of individuals than the first set of nucleic acids; and/or the first set of nucleic acids is from at least 8 individuals; and/or the first set of nucleic acids is from at least 4 individuals from a first subgroup and at least 4 individuals from a second subgroup which is preferably non-overlapping with the first subgroup.

In a further aspect of the invention:

the second set of nucleic acids represents an unselected group; and/or wherein the second set of nucleic acids is bound to an array at defined locations; and/or wherein the second set of nucleic acids represents chromosome interactions in least 100 different genes; and/or wherein the second set of nucleic acids comprises at least 1,000 different nucleic acids representing at least 1,000 different chromosome interactions; and/or wherein the first set of nucleic acids and the second set of nucleic acids comprise at least 100 nucleic acids with length 10 to 100 nucleotide bases.

The Second Set of Nucleic Acids—the 'Index' Sequences

The second set of nucleic acid sequences has the function of being a set of index sequences, and is essentially a set of nucleic acid sequences which are suitable for identifying subgroup specific sequence. They can represents the 'background' chromosomal interactions and might be selected in some way or be unselected. They are in general a subset of all possible chromosomal interactions.

The second set of nucleic acids may be derived by any suitable process. They can be derived computationally or they may be based on chromosome interaction in individuals. They typically represent a larger population group than the first set of nucleic acids. In one particular aspect, the second set of nucleic acids represents all possible epigenetic chromosomal interactions in a specific set of genes. In another particular aspect, the second set of nucleic acids represents a large proportion of all possible epigenetic chromosomal interactions present in a population described herein. In one particular aspect, the second set of nucleic acids represents at least 50% or at least 80% of epigenetic chromosomal interactions in at least 20, 50, 100 or 500 genes, for example in 20 to 100 or 50 to 500 genes.

The second set of nucleic acids typically represents at least 100 possible epigenetic chromosome interactions which modify, regulate or in any way mediate a phenotype in population. The second set of nucleic acids may represent chromosome interactions that affect a disease state (typically relevant to diagnosis or prognosis) in a species. The second set of nucleic acids typically comprises sequences representing epigenetic interactions both relevant and not relevant to a prognosis subgroup.

In one particular aspect the second set of nucleic acids derive at least partially from naturally occurring sequences in a population, and are typically obtained by in silico processes. Said nucleic acids may further comprise single or multiple mutations in comparison to a corresponding portion of nucleic acids present in the naturally occurring nucleic acids. Mutations include deletions, substitutions and/or additions of one or more nucleotide base pairs. In one particular aspect, the second set of nucleic acids may comprise sequence representing a homologue and/or orthologue with at least 70% sequence identity to the corresponding portion of nucleic acids present in the naturally occurring species. In another particular aspect, at least 80% sequence identity or at least 90% sequence identity to the corresponding portion of nucleic acids present in the naturally occurring species is provided.

Properties of the Second Set of Nucleic Acids

In one particular aspect, there are at least 100 different nucleic acid sequences in the second set of nucleic acids, preferably at least 1000, 2000 or 5000 different nucleic acids sequences, with up to 100,000, 1,000,000 or 10,000,000 different nucleic acid sequences. A typical number would be 100 to 1,000,000, such as 1,000 to 100,000 different nucleic acids sequences. All or at least 90% or at least 50% or these would correspond to different chromosomal interactions.

In one particular aspect, the second set of nucleic acids represent chromosome interactions in at least 20 different loci or genes, preferably at least 40 different loci or genes, and more preferably at least 100, at least 500, at least 1000 or at least 5000 different loci or genes, such as 100 to 10,000 different loci or genes. The lengths of the second set of nucleic acids are suitable for them to specifically hybridise according to Watson Crick base pairing to the first set of nucleic acids to allow identification of chromosome interactions specific to subgroups. Typically the second set of nucleic acids will comprise two portions corresponding in sequence to the two chromosome regions which come together in the chromosome interaction. The second set of nucleic acids typically comprise nucleic acid sequences which are at least 10, preferably 20, and preferably still 30 bases (nucleotides) in length. In another aspect, the nucleic acid sequences may be at the most 500, preferably at most 100, and preferably still at most 50 base pairs in length. In a preferred aspect, the second set of nucleic acids comprises nucleic acid sequences of between 17 and 25 base pairs. In one aspect at least 100, 80% or 50% of the second set of nucleic acid sequences have lengths as described above. Preferably the different nucleic acids do not have any overlapping sequences, for example at least 100%, 90%, 80% or 50% of the nucleic acids do not have the same sequence over at least 5 contiguous nucleotides.

Given that the second set of nucleic acids acts as an 'index' then the same set of second nucleic acids may be used with different sets of first nucleic acids which represent subgroups for different characteristics, i.e. the second set of nucleic acids may represent a 'universal' collection of nucleic acids which can be used to identify chromosome interactions relevant to different characteristics.

The First Set of Nucleic Acids

The first set of nucleic acids are typically from subgroups relevant to prognosis. The first nucleic acids may have any of the characteristics and properties of the second set of nucleic acids mentioned herein. The first set of nucleic acids is normally derived from samples from the individuals which have undergone treatment and processing as described herein, particularly the EpiSwitch™ cross-linking and cleaving steps. Typically the first set of nucleic acids represents all or at least 80% or 50% of the chromosome interactions present in the samples taken from the individuals.

Typically, the first set of nucleic acids represents a smaller population of chromosome interactions across the loci or genes represented by the second set of nucleic acids in comparison to the chromosome interactions represented by second set of nucleic acids, i.e. the second set of nucleic acids is representing a background or index set of interactions in a defined set of loci or genes.

Library of Nucleic Acids

Any of the types of nucleic acid populations mentioned herein may be present in the form of a library comprising at least 200, at least 500, at least 1000, at least 5000 or at least 10000 different nucleic acids of that type, such as 'first' or 'second' nucleic acids. Such a library may be in the form of being bound to an array. The library may comprise some or all of the probes or primer pairs shown in any of Tables 1, 2, 3 or 4. The library may be in the form of a composition or may be in the form of a kit where the nucleic acids are provided in separate containers.

Hybridisation

The invention requires a means for allowing wholly or partially complementary nucleic acid sequences from the first set of nucleic acids and the second set of nucleic acids to hybridise. In one aspect all of the first set of nucleic acids is contacted with all of the second set of nucleic acids in a single assay, i.e. in a single hybridisation step. However any suitable assay can be used.

Labelled Nucleic Acids and Pattern of Hybridisation

The nucleic acids mentioned herein may be labelled, preferably using an independent label such as a fluorophore (fluorescent molecule) or radioactive label which assists detection of successful hybridisation. Certain labels can be detected under UV light. The pattern of hybridisation, for example on an array described herein, represents differences in epigenetic chromosome interactions between the two subgroups, and thus provides a process of comparing epigenetic chromosome interactions and determination of which epigenetic chromosome interactions are specific to a subgroup in the population of the present invention.

The term 'pattern of hybridisation' broadly covers the presence and absence of hybridisation between the first and second set of nucleic acids, i.e. which specific nucleic acids from the first set hybridise to which specific nucleic acids from the second set, and so it not limited to any particular assay or technique, or the need to have a surface or array on which a 'pattern' can be detected.

Selecting a Subgroup with Particular Characteristics

The invention provides a process which comprises detecting the presence or absence of chromosome interactions, typically 5 to 20 or 5 to 500 such interactions, preferably 20 to 300 or 50 to 100 interactions, in order to determine the presence or absence of a characteristic relating to prognosis in an individual. Preferably the chromosome interactions are those in any of the genes mentioned herein. In one aspect the chromosome interactions which are typed are those represented by the nucleic acids in Table 1, 2, 3 or 4. The column titled 'Loop Detected' in the tables shows which subgroup is detected by each probe. Detection can either of the presence or absence of the chromosome interaction in that subgroup.

The Individual that is Tested

The individual who is tested is typically of any species mentioned herein. In addition the individual that is tested in the process of the invention may have been selected in some way. The individual may be susceptible to any condition mentioned herein and/or may be in need of any therapy mentioned in. The individual may be receiving any therapy mentioned herein. In particular, the individual may have, or be suspected of having ASD.

The individual may be suspected of having any specific condition that comes within the broad definition of ASD. That may be autistic disorder, childhood autism, Asperger's syndrome, PDD-NOS (Pervasive Development Disorder), childhood disintegrative disorder, addiction (for example addiction to substances or digital media devices).

Typing Combinations of Markers

The invention includes a process wherein a specific combination of chromosome interactions are typed:

(i) comprising all of the chromosome interactions represented by the probes in Table 1, 2, 3 or 4; and/or (ii) comprising at least 25, 50, 100, 150 or 200 of the chromosome interactions represented by the probes in Table 1, 2, 3 or 4; and/or (iii) which together are present in at least 10, 20, 30 or 40 of the regions or genes listed in Table 1, 2, 3 or 4; and/or (iv) wherein at least 10, 20, 30 or 40 of the chromosome interactions which are typed are present in a 4,000 base region which comprises or which flanks the chromosome interactions represented by the probes in Table 1, 2, 3 or 4.

Typically in the process of the invention at least 20, 30, 40 or 50 chromosome interactions are typed.

Preferred Gene Regions, Loci, Genes and Chromosome Interactions

For all aspects of the invention preferred gene regions, loci, genes and chromosome interactions are mentioned in the tables, for example in Table 1, 2, 3 or 4. Typically in the process of the invention chromosome interactions are detected from at least 10, 20, 30, 40 or 50 of the genes listed in Table 1. Typically in the process of the invention chromosome interactions are detected from at least 10, 20, 30, 40 or 50 of the genes listed in Table 2. Typically in the process of the invention chromosome interactions are detected from at least 10, 20, 30, 40 or 50 of the genes listed in Table 3. Typically in the process of the invention chromosome interactions are detected from at least 10, 20, 30, 40 or 50 of the genes listed in Table 4.

Preferably the presence or absence of at least 10, 20, 50, 150 or 200 of the relevant specific chromosome interactions represented by the probe sequences in Table 1 are detected. Preferably the presence or absence of at least 10, 20, 50, 150 or 200 of the relevant specific chromosome interactions represented by the probe sequences in Table 2 are detected. Preferably the presence or absence of at least 10, 20, 50, 150 or 200 of the relevant specific chromosome interactions represented by the probe sequences in Table 3 are detected. Preferably the presence or absence of at least 10, 20, 50, 150 or 200 of the relevant specific chromosome interactions represented by the probe sequences in Table 4 are detected. The chromosome interaction may be upstream or downstream of any of the genes mentioned herein, for example within 50 kb upstream or 20 kb downstream, for example from the coding sequence.

Preferred Combinations and Numbers of Markers

In one aspect the invention relates to typing markers represented in Table 1. In this aspect the markers which are typed may or may not be present in any other table. The invention therefore includes a process for determining prognosis to ASD by typing one or more of the chromosome interactions represented in Table 1. Typically the presence or absence of at least 1, 5, 8, 10, 15, 20 chromosome interactions from Table 1 are detected.

In one aspect the invention relates to typing markers represented in Table 2. In this aspect the markers which are typed may or may not be present in any other table. The invention therefore includes a process for determining prognosis to ASD by typing one or more of the chromosome interactions represented in Table 2. Typically the presence or absence of at least 1, 5, 8, 10, 15, 20 chromosome interactions from Table 2 are detected.

In one aspect the invention relates to typing markers represented in Table 3. In this aspect the markers which are typed may or may not be present in any other table. The invention therefore includes a process for determining prognosis to ASD by typing one or more of the chromosome interactions represented in Table 3. Typically the presence or absence of at least 1, 5, 8, 10, 15, 20 chromosome interactions from Table 3 are detected.

In one aspect the invention relates to typing markers represented in Table 4. In this aspect the markers which are typed may or may not be present in any other table. The invention therefore includes a process for determining prognosis to ASD by typing one or more of the chromosome interactions represented in Table 4. Typically the presence or absence of at least 1, 5, 8, 10, 15, 20 chromosome interactions from Table 4 are detected.

In one aspect the invention relates to typing markers represented in Table 8. In this aspect the markers which are typed may or may not be present in any other table. The invention therefore includes a process for determining prognosis to ASD by typing one or more of the chromosome interactions represented in Table 8. Typically the presence or absence of at least 1, 5, 8, 10, 15, 20 chromosome interactions from Table 8 are detected. In one aspect the presence or absence of at least 30, 50, 80, 100 or 150 interactions from Table 8 are detected.

Table 8 contains groups of markers within in it defined as follows:

Group A: markers numbered 1 to 12
Group B: markers numbered 13 to 76 and 139 to 167
Group C: markers numbered 77 to 138
Group D: markers numbered 168 to 183

Typically the presence or absence of at least 1, 5, 8, 10 or all the chromosome interactions from Group A of Table 8 are detected. In one aspect the presence or absence of at least 1, 5, 8, 10, 15, 20 or all the chromosome interactions from Group B of Table 8 are detected. Typically the presence or absence of at least 1, 5, 8, 10, 15, 20 or all the chromosome interactions from Group C of Table 8 are detected. In one aspect the presence or absence of at least 1, 5, 8, 10, 15, 20 or all the chromosome interactions from Group D of Table 8 are detected.

In one aspect the invention relates to typing markers represented in Table 9. In this aspect the markers which are typed may or may not be present in any other table. The invention therefore includes a process for determining prognosis to ASD by typing one or more of the chromosome interactions represented in Table 9. Typically the presence or absence of at least 1, 5, 8, 10, 15, 20 chromosome interactions from Table 9 are detected. In one aspect the presence or absence of at least 30, 50, 80, 100 or 150 interactions from Table 9 are detected.

Table 9 contains groups of markers within in it defined as follows:

Group A: markers numbered 2 to 7 and 9 to 15
Group B: markers numbered 1, 8, 16 to 87 and 149 to 171
Group C: markers numbered 88 to 148
Group D: markers numbered 172 to 182

Typically the presence or absence of at least 1, 5, 8, 10 or all the chromosome interactions from Group A of Table 9 are detected. In one aspect the presence or absence of at least 1, 5, 8, 10, 15, 20 or all the chromosome interactions from Group B of Table 9 are detected. Typically the presence or absence of at least 1, 5, 8, 10, 15, 20 or all the chromosome interactions from Group C of Table 9 are detected. In one aspect the presence or absence of at least 1, 5, 8 or all the chromosome interactions from Group D of Table 9 are detected.

In one aspect the presence or absence of at least 1, 5, 8, 10, 15, 20 or all the chromosome interactions from Table 10 are detected. In a preferred aspect one or both of the first two markers of Table 10 are typed.

Typing Chromosome Interactions Mentioned in the Figures

In one aspect the method of the invention comprises typing one or more chromosome interactions which relate to any gene mentioned in any of the Figures (as defined in the tables). Typically at least 1, 5, 8, 10, 15 or 20 such interactions are typed.

Typing Different Types of ASD

As will be appreciated from the tables different markers are specific for different types of ASD (defined either by their presence or absence). The process of the invention typically comprises typing markers with any of the following characteristics:

(i) present in healthy controls (HC), but absent in mild and severe ASD (ii) unique of either mild or severe ASD, and absent in HC (iii) common or present in severe and mild ASD, but absent in HC (iv) present or absent in either severe or mild ASD.

In one aspect at least 1, 5, 8, 10, 15 or 20 chromosome interactions are typed which have characteristic (i). In a further aspect at least 1, 5, 8, 10, 15 or 20 chromosome interactions are typed which have characteristic (ii). In one aspect at least 1, 5, 8, 10, 15 or 20 chromosome interactions are typed which have characteristic (iii). In a further aspect at least 1, 5, 8, 10, 15 or 20 chromosome interactions are typed which have characteristic (vi).

Types of Chromosome Interaction

In one aspect the locus (including the gene and/or place where the chromosome interaction is detected) may comprise a CTCF binding site. This is any sequence capable of binding transcription repressor CTCF. That sequence may consist of or comprise the sequence CCCTC which may be present in 1, 2 or 3 copies at the locus. The CTCF binding site sequence may comprise the sequence CCGCGNGG-NGGCAG (in IUPAC notation SEQ ID NO: 1). The CTCF binding site may be within at least 100, 500, 1000 or 4000 bases of the chromosome interaction or within any of the chromosome regions shown Table 1, 2, 3 or 4. The CTCF binding site may be within at least 100, 500, 1000 or 4000 bases of the chromosome interaction or within any of the chromosome regions shown Table 1, 2, 3 or 4.

In one aspect the chromosome interactions which are detected are present at any of the gene regions shown Table 1, 2, 3 or 4. In the case where a ligated nucleic acid is detected in the process then sequence shown in any of the probe sequences in Table 1, 2, 3 or 4 may be detected.

Thus typically sequence from both regions of the probe (i.e. from both sites of the chromosome interaction) could be detected. In preferred aspects probes are used in the process which comprise or consist of the same or complementary sequence to a probe shown in any table. In some aspects probes are used which comprise sequence which is homologous to any of the probe sequences shown in the tables.

In one aspect one or more of the chromosome interactions which are typed are at a locus/region that:

(i) comprises a single nucleotide polymorphism (SNP); and/or (ii) expresses a microRNA (miRNA); and/or (iii) expresses a non-coding RNA (ncRNA); and/or (iv) expresses a nucleic acid sequence encoding at least 10 contiguous amino acid residues; and/or (v) expresses a regulating element; and/or (vii) comprises a CTCF binding site.

Description of the Tables

Table 1 shows markers present in healthy control, but absent in severe and mild autism. The designation 'mHC' means it is absent both in mild and severe (mHC, means from the mild comparison with HC). The designation 'sHC' means it is absent both in mild and severe (sHC, means from the severe comparison with HC).

Table 2 shows unique markers present in mild and severe autism. The designation 'sAD' means it is absent in control and mild. The designation 'mAD' means it is absent in control and severe.

Table 3 shows shared markers, present in severe and mild autism. The designation 'sAD' means present in mild (means from the severe comparison with HC). The designation 'mAD' means present in severe (means from the mild comparison with HC).

Table 4 shows unique markers either absent in severe or mild autism. The designation 'sHC' means present in healthy control, but only for the comparison between severe and HC patients. This doesn't say anything about the mild status. The designation 'mHC' means present in healthy control, but only for the comparison between mild and HC patients. This doesn't say anything about the severe status.

Table 8 shows markers relating to severe autism. Four groups of markers are shown in this table, Group A, B, C and D as defined above and shown in the table. Markers may be selected from the entire table or from a group.

Table 9 shows markers relating to mild autism. Four groups of markers are shown in this table, Group A, B, C and D as defined above and shown in the table. Markers may be selected from the entire table or from a group.

Table 10 shows markers with a high performance and is an optimised panel. In particular this panel comprises chromosome interactions relating to NAMPT and MAP2 (marker numbers 1 and 2 in the table).

The LS column in all tables either has '1' or '−1'. This reflects how the comparison is done, the healthy control is always the numerator, and so significant markers present in HC will be 1 and the disease samples (mild or severe) are always the denominator, and so significant markers present in the disease samples will always be −1.

The tables shows probe (Episwitch™ marker) data and gene data representing chromosome interactions relevant to prognosis. The probe sequences show sequence which can be used to detect a ligated product generated from both sites of gene regions that have come together in chromosome interactions, i.e. the probe will comprise sequence which is complementary to sequence in the ligated product. The first two sets of Start-End positions show probe positions, and the second two sets of Start-End positions show the relevant 4 kb region. The following information is provided in the probe data table:

HyperG_Stats: p-value for the probability of finding that number of significant EpiSwitch™ markers in the locus based on the parameters of hypergeometric enrichment Probe Count Total: Total number of EpiSwitch™ Conformations tested at the locus Probe Count Sig: Number of EpiSwitch™ Conformations found to be statistically significant at the locus FDR HyperG: Multi-test (False Discovery Rate) corrected hypergeometric p-value Percent Sig: Percentage of significant EpiSwitch™ markers relative the number of markers tested at the locus log FC: logarithm base 2 of Epigenetic Ratio (FC)

AveExpr: average log 2-expression for the probe over all arrays and channels

T: moderated t-statistic p-value: raw p-value adj. p-value: adjusted p-value or q-value B—B-statistic (lods or B) is the log-odds that that gene is differentially expressed.

FC—non-log Fold Change

FC_1—non-log Fold Change centred around zero

LS—Binary value this relates to FC_1 values. FC_1 value below −1.1 it is set to −1 and if the FC_1 value is above 1.1 it is set to 1. Between those values the value is 0

The tables show genes where a relevant chromosome interaction has been found to occur. The p-value in the loci table is the same as the HyperG Stats (p-value for the probability of finding that number of significant EpiSwitch™ markers in the locus based on the parameters of hypergeometric enrichment). The LS column shows presence or absence of the relevant interaction with that particular subgroup (prognosis status).

The probes are designed to be 30 bp away from the Taq1 site. In case of PCR, PCR primers are typically designed to detect ligated product but their locations from the Taq1 site vary.

Probe Locations:

Start 1—30 bases upstream of Taql site on fragment 1

End 1—Taql restriction site on fragment 1

Start 2—Taql restriction site on fragment 2

End 2—30 bases downstream of Taql site on fragment 2

4 kb Sequence Location:

Start 1—4000 bases upstream of Taql site on fragment 1

End 1—Taql restriction site on fragment 1

Start 2—Taql restriction site on fragment 2

End 2—4000 bases downstream of Taql site on fragment 2

GLMNET values related to procedures for fitting the entire lasso or elastic-net regularization (Lambda set to 0.5 (elastic-net)).

Certain markers are shown twice where they relate to shared markers, once referred to for presence/absence in mild and once in severe autism.

Preferred Aspects for Sample Preparation and Chromosome Interaction Detection

Methods of preparing samples and detecting chromosome conformations are described herein. Optimised (non-conventional) versions of these methods can be used, for example as described in this section.

Typically the sample will contain at least $2 \times 10^5$ cells. The sample may contain up to $5 \times 10^5$ cells. In one aspect, the sample will contain $2 \times 10^5$ to $5.5 \times 10^5$ cells.

Crosslinking of epigenetic chromosomal interactions present at the chromosomal locus is described herein. This may be performed before cell lysis takes place. Cell lysis may be performed for 3 to 7 minutes, such as 4 to 6 or about 5 minutes. In some aspects, cell lysis is performed for at least 5 minutes and for less than 10 minutes.

Digesting DNA with a restriction enzyme is described herein. Typically, DNA restriction is performed at about 55° C. to about 70° C., such as for about 65° C., for a period of about 10 to 30 minutes, such as about 20 minutes.

Preferably a frequent cutter restriction enzyme is used which results in fragments of ligated DNA with an average fragment size up to 4000 base pair. Optionally the restriction enzyme results in fragments of ligated DNA have an average fragment size of about 200 to 300 base pairs, such as about 256 base pairs. In one aspect, the typical fragment size is from 200 base pairs to 4,000 base pairs, such as 400 to 2,000 or 500 to 1,000 base pairs.

In one aspect of the EpiSwitch method a DNA precipitation step is not performed between the DNA restriction digest step and the DNA ligation step.

DNA ligation is described herein. Typically the DNA ligation is performed for 5 to 30 minutes, such as about 10 minutes.

The protein in the sample may be digested enzymatically, for example using a proteinase, optionally Proteinase K. The protein may be enzymatically digested for a period of about 30 minutes to 1 hour, for example for about 45 minutes. In one aspect after digestion of the protein, for example Proteinase K digestion, there is no cross-link reversal or phenol DNA extraction step.

In one aspect PCR detection is capable of detecting a single copy of the ligated nucleic acid, preferably with a binary read-out for presence/absence of the ligated nucleic acid.

FIG. 10 shows a preferred method of detecting chromosome interactions.

Processes and Uses of the Invention

The process of the invention can be described in different ways. It can be described as a method of making a ligated nucleic acid comprising (i) in vitro cross-linking of chromosome regions which have come together in a chromosome interaction; (ii) subjecting said cross-linked DNA to cutting or restriction digestion cleavage; and (iii) ligating said cross-linked cleaved DNA ends to form a ligated nucleic acid, wherein detection of the ligated nucleic acid may be used to determine the chromosome state at a locus, and wherein preferably:

the locus may be any of the loci, regions or genes mentioned in Table 1, 2, 3 or 4, and/or wherein the chromosomal interaction may be any of the chromosome interactions mentioned herein or corresponding to any of the probes disclosed in Table 1, 2, 3 or 4, and/or wherein the ligated product may have or comprise (i) sequence which is the same as or homologous to any of the probe sequences disclosed in Table 1, 2, 3 or 4; or (ii) sequence which is complementary to (ii).

The process of the invention can be described as a process for detecting chromosome states which represent different subgroups in a population comprising determining whether a chromosome interaction is present or absent within a defined epigenetically active region of the genome, wherein preferably:

the subgroup is defined by presence or absence of a condition or by the type of condition, and/or the chromosome state may be at any locus, region or gene mentioned in Table 1, 2, 3 or 4; and/or the chromosome interaction may be any of those mentioned in Table 1, 2, 3 or 4 or corresponding to any of the probes disclosed in that table.

The invention includes detecting chromosome interactions at any locus, gene or region mentioned Table 1, 2, 3 or 4. The invention includes use of the nucleic acids and probes mentioned herein to detect chromosome interactions, for example use of at least 1, 5, 10, 20 or 50 such nucleic acids or probes to detect chromosome interactions. The nucleic acids or probes preferably detect chromosome interactions in at least 1, 5, 10, 20 or 50 different loci or genes. The invention includes detection of chromosome interactions using any of the primers or primer pairs listed in Table 1, 2, 3 or 4 or using variants of these primers as described herein (sequences comprising the primer sequences or comprising fragments and/or homologues of the primer sequences).

When analysing whether a chromosome interaction occurs 'within' a defined gene, region or location, either both the parts of the chromosome which have together in the interaction are within the defined gene, region or location or in some aspects only one part of the chromosome is within the defined, gene, region or location.

The markers shown in the tables are 'disseminating' ones whose presence or absence is associated with a particular ASD status as defined herein (as shown in the relevant table). Therefore the result of the process of the invention is analysed with reference to the way in which the marker associates with the ASD status.

Use of the Method of the Invention to Identify New Treatments

Knowledge of chromosome interactions can be used to identify new treatments for ASD. The invention provides methods and uses of chromosomes interactions defined herein to identify or design new therapeutic agents, for example relating to therapy of ASD.

Homologues

Homologues of polynucleotide/nucleic acid (e.g. DNA) sequences are referred to herein. Such homologues typically have at least 70% homology, preferably at least 80%, at least 85%, at least 90%, at least 95%, at least 97%, at least 98% or at least 99% homology, for example over a region of at least 10, 15, 20, 30, 100 or more contiguous nucleotides, or across the portion of the nucleic acid which is from the region of the chromosome involved in the chromosome interaction. The homology may be calculated on the basis of nucleotide identity (sometimes referred to as "hard homology").

Therefore, in a particular aspect, homologues of polynucleotide/nucleic acid (e.g. DNA) sequences are referred to herein by reference to percentage sequence identity. Typically such homologues have at least 70% sequence identity, preferably at least 80%, at least 85%, at least 90%, at least 95%, at least 97%, at least 98% or at least 99% sequence identity, for example over a region of at least 10, 15, 20, 30, 100 or more contiguous nucleotides, or across the portion of the nucleic acid which is from the region of the chromosome involved in the chromosome interaction.

For example the UWGCG Package provides the BEST-FIT program which can be used to calculate homology and/or % sequence identity (for example used on its default settings) (Devereux et al (1984) Nucleic Acids Research 12, p 387-395). The PILEUP and BLAST algorithms can be used to calculate homology and/or % sequence identity and/or line up sequences (such as identifying equivalent or corresponding sequences (typically on their default settings)), for example as described in Altschul S. F. (1993) J Mol Evol 36:290-300; Altschul, S, F et al (1990) J Mol Biol 215:403-10.

Software for performing BLAST analyses is publicly available through the National Center for Biotechnology Information. This algorithm involves first identifying high scoring sequence pair (HSPs) by identifying short words of length W in the query sequence that either match or satisfy some positive-valued threshold score T when aligned with a word of the same length in a database sequence. T is referred to as the neighbourhood word score threshold (Altschul et al, supra). These initial neighbourhood word hits act as seeds for initiating searches to find HSPs containing them. The word hits are extended in both directions along each sequence for as far as the cumulative alignment score can be increased. Extensions for the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W5 T and X determine the sensitivity and speed of the alignment. The BLAST program uses as defaults a word length (W) of 11, the BLOSUM62 scoring matrix (see Henikoff and Henikoff (1992) Proc. Natl. Acad. Sci. USA 89:10915-10919) alignments (B) of 50, expectation (E) of 10, M=5, N=4, and a comparison of both strands.

The BLAST algorithm performs a statistical analysis of the similarity between two sequences; see e.g., Karlin and Altschul (1993) Proc. Natl. Acad. Sci. USA 90:5873-5787. One measure of similarity provided by the BLAST algorithm is the smallest sum probability (P(N)), which provides an indication of the probability by which a match between two polynucleotide sequences would occur by chance. For example, a sequence is considered similar to another sequence if the smallest sum probability in comparison of the first sequence to the second sequence is less than about 1, preferably less than about 0.1, more preferably less than about 0.01, and most preferably less than about 0.001.

The homologous sequence typically differs by 1, 2, 3, 4 or more bases, such as less than 10, 15 or 20 bases (which may be substitutions, deletions or insertions of nucleotides). These changes may be measured across any of the regions mentioned above in relation to calculating homology and/or % sequence identity.

Homology of a 'pair of primers' can be calculated, for example, by considering the two sequences as a single sequence (as if the two sequences are joined together) for the purpose of then comparing against the another primer pair which again is considered as a single sequence.

Arrays

The second set of nucleic acids may be bound to an array, and in one aspect there are at least 15,000, 45,000, 100,000 or 250,000 different second nucleic acids bound to the array, which preferably represent at least 300, 900, 2000 or 5000 loci. In one aspect one, or more, or all of the different populations of second nucleic acids are bound to more than one distinct region of the array, in effect repeated on the array allowing for error detection. The array may be based on an Agilent SurePrint G3 Custom CGH microarray platform. Detection of binding of first nucleic acids to the array may be performed by a dual colour system.

Therapeutic Agents (for Example which are Selected Based on Typing Individuals or which are Selected Based on Testing According to the Invention)

Therapeutic agents are mentioned herein. The invention provides such agents for use in preventing or treating a disease condition in certain individuals, for example those identified by a process of the invention. This may comprise administering to an individual in need a therapeutically effective amount of the agent. The invention provides use of the agent in the manufacture of a medicament to prevent or treat a condition in certain individuals.

The formulation of the agent will depend upon the nature of the agent. The agent will be provided in the form of a pharmaceutical composition containing the agent and a pharmaceutically acceptable carrier or diluent. Suitable carriers and diluents include isotonic saline solutions, for example phosphate-buffered saline. Typical oral dosage compositions include tablets, capsules, liquid solutions and liquid suspensions. The agent may be formulated for parenteral, intravenous, intramuscular, subcutaneous, transdermal or oral administration.

The dose of an agent may be determined according to various parameters, especially according to the substance used; the age, weight and condition of the individual to be treated; the route of administration; and the required regimen. A physician will be able to determine the required route of administration and dosage for any particular agent. A suitable dose may however be from 0.1 to 100 mg/kg body weight such as 1 to 40 mg/kg body weight, for example, to be taken from 1 to 3 times daily.

The therapeutic agent may be any such agent disclosed herein, or may target any 'target' disclosed herein, including any protein or gene disclosed herein in any table (including Table 1, 2, 3 or 4).

ASD Therapy

Any anti-ASD therapy may be used in the present invention, for example any drug that target ASD symptoms, such as aiming to modulate behaviour. The therapy may be a psychoactive drug, anticonvulsant, antidepressant, or antipsychotics. The antipsychotic may be risperidone or aripiprazole.

Forms of the Substance Mentioned Herein

Any of the substances, such as nucleic acids or therapeutic agents, mentioned herein may be in purified or isolated form. They may be in a form which is different from that found in nature, for example they may be present in combination with other substance with which they do not occur in nature. The nucleic acids (including portions of sequences defined herein) may have sequences which are different to those found in nature, for example having at least 1, 2, 3, 4 or more nucleotide changes in the sequence as described in the section on homology. The nucleic acids may have heterologous sequence at the 5' or 3' end. The nucleic acids may be chemically different from those found in nature, for example they may be modified in some way, but preferably are still capable of Watson-Crick base pairing. Where appropriate the nucleic acids will be provided in double stranded or single stranded form. The invention provides all of the specific nucleic acid sequences mentioned herein in single or double stranded form, and thus includes the complementary strand to any sequence which is disclosed.

The invention provides a kit for carrying out any process of the invention, including detection of a chromosomal interaction relating to prognosis. Such a kit can include a specific binding agent capable of detecting the relevant chromosomal interaction, such as agents capable of detecting a ligated nucleic acid generated by processes of the invention. Preferred agents present in the kit include probes capable of hybridising to the ligated nucleic acid or primer pairs, for example as described herein, capable of amplifying the ligated nucleic acid in a PCR reaction.

The invention provides a device that is capable of detecting the relevant chromosome interactions. The device preferably comprises any specific binding agents, probe or primer pair capable of detecting the chromosome interaction, such as any such agent, probe or primer pair described herein.

Detection Methods

In one aspect quantitative detection of the ligated sequence which is relevant to a chromosome interaction is carried out using a probe which is detectable upon activation during a PCR reaction, wherein said ligated sequence comprises sequences from two chromosome regions that come together in an epigenetic chromosome interaction, wherein said method comprises contacting the ligated sequence with the probe during a PCR reaction, and detecting the extent of activation of the probe, and wherein said probe binds the ligation site. The method typically allows particular interactions to be detected in a MIQE compliant manner using a dual labelled fluorescent hydrolysis probe.

The probe is generally labelled with a detectable label which has an inactive and active state, so that it is only detected when activated. The extent of activation will be related to the extent of template (ligation product) present in the PCR reaction. Detection may be carried out during all or some of the PCR, for example for at least 50% or 80% of the cycles of the PCR.

The probe can comprise a fluorophore covalently attached to one end of the oligonucleotide, and a quencher attached to the other end of the nucleotide, so that the fluorescence of the fluorophore is quenched by the quencher. In one aspect the fluorophore is attached to the 5'end of the oligonucleotide, and the quencher is covalently attached to the 3' end of the oligonucleotide. Fluorophores that can be used in the methods of the invention include FAM, TET, JOE, Yakima Yellow, HEX, Cyanine3, ATTO 550, TAMRA, ROX, Texas Red, Cyanine 3.5, LC610, LC 640, ATTO 647N, Cyanine 5, Cyanine 5.5 and ATTO 680. Quenchers that can be used with the appropriate fluorophore include TAM, BHQ1, DAB, Eclip, BHQ2 and BBQ650, optionally wherein said fluorophore is selected from HEX, Texas Red and FAM. Preferred combinations of fluorophore and quencher include FAM with BHQ1 and Texas Red with BHQ2.

Use of the Probe in a qPCR Assay

Hydrolysis probes of the invention are typically temperature gradient optimised with concentration matched negative controls. Preferably single-step PCR reactions are optimized. More preferably a standard curve is calculated. An advantage of using a specific probe that binds across the junction of the ligated sequence is that specificity for the ligated sequence can be achieved without using a nested PCR approach. The methods described herein allow accurate and precise quantification of low copy number targets. The target ligated sequence can be purified, for example gel-purified, prior to temperature gradient optimization. The target ligated sequence can be sequenced. Preferably PCR reactions are performed using about 10 ng, or 5 to 15 ng, or 10 to 20 ng, or 10 to 50 ng, or 10 to 200 ng template DNA. Forward and reverse primers are designed such that one primer binds to the sequence of one of the chromosome regions represented in the ligated DNA sequence, and the other primer binds to other chromosome region represented in the ligated DNA sequence, for example, by being complementary to the sequence.

Choice of Ligated DNA Target

The invention includes selecting primers and a probe for use in a PCR method as defined herein comprising selecting primers based on their ability to bind and amplify the ligated sequence and selecting the probe sequence based properties of the target sequence to which it will bind, in particular the curvature of the target sequence.

Probes are typically designed/chosen to bind to ligated sequences which are juxtaposed restriction fragments spanning the restriction site. In one aspect of the invention, the predicted curvature of possible ligated sequences relevant to a particular chromosome interaction is calculated, for example using a specific algorithm referenced herein. The curvature can be expressed as degrees per helical turn, e.g. 10.5° per helical turn. Ligated sequences are selected for targeting where the ligated sequence has a curvature propensity peak score of at least 5° per helical turn, typically at least 10°, 15° or 20° per helical turn, for example 5° to 20° per helical turn. Preferably the curvature propensity score per helical turn is calculated for at least 20, 50, 100, 200 or 400 bases, such as for 20 to 400 bases upstream and/or downstream of the ligation site. Thus in one aspect the target sequence in the ligated product has any of these levels of curvature. Target sequences can also be chosen based on lowest thermodynamic structure free energy.

Particular Aspects

In one aspect only intrachromosomal interactions are typed/detected, and no extrachromosomal interactions (between different chromosomes) are typed/detected.

In particular aspects certain chromosome interactions are not typed, for example any specific interaction mentioned herein (for example as defined by any probe or primer pair mentioned herein). In some aspects chromosome interactions are not typed in any of the genes mentioned herein.

In one aspect markers not listed in any one of the tables are not typed, for example only markers listed in Table 10 are typed.

Screening Method

The invention provides a method of determining which chromosomal interactions are relevant to a chromosome state corresponding to an prognosis subgroup of the population, comprising contacting a first set of nucleic acids from subgroups with different states of the chromosome with a second set of index nucleic acids, and allowing complementary sequences to hybridise, wherein the nucleic acids in the first and second sets of nucleic acids represent a ligated product comprising sequences from both the chromosome regions that have come together in chromosomal interactions, and wherein the pattern of hybridisation between the first and second set of nucleic acids allows a determination of which chromosomal interactions are specific to an prognosis subgroup. The subgroup may be any of the specific subgroups defined herein, for example with reference to particular conditions or therapies.

The invention further provides a process which uses the prognosis/detection method of the invention to identify or design a therapeutic agent for ASD;

wherein preferably said process is used to detect whether a candidate agent is able to cause a change to a chromosome state which is associated with ASD;

wherein the chromosomal interaction is represented by any probe in Table 1, 2, 3 or 4; and/or the chromosomal interaction is present in any region or gene listed in Table 1, 2, 3 or 4;

and wherein optionally:

the chromosomal interaction has been identified by the method of determining which chromosomal interactions are relevant to a chromosome state as defined in claim 1, and/or the change in chromosomal interaction is monitored using (i) a probe that has at least 70% identity to any of the probe sequences mentioned in Table 1, 2, 3 or 4, and/or (ii) by a primer pair which has at least 70% identity to any primer pair in Table 1, 2, 3 or 4.

Typing of the 'Disseminating' Markers

The data provided herein shows that the markers are 'disseminating' ones able to differentiate cases and non-cases for the relevant disease situation. Therefore when carrying out the invention the skilled person will be able to determine by detection of the interactions which subgroup the individual is in. In one aspect a threshold value of detection of at least 70% of the tested markers in the form they are associated with the relevant disease situation (either by absence or presence) may be used to determine whether the individual is in the relevant subgroup. In other aspects a threshold value of at least 80% or at least 90% may be used.

In one aspect a classifier may be used to as part of the detection process, for example utilising a trained algorithm which comprises information relating to one or more disseminating markers, for example as defined in any one of the table herein.

Publications

The contents of all publications mentioned herein are incorporated by reference into the present specification and may be used to further define the features relevant to the invention.

The Approach Taken to Identify Markers and Panels of Markers

The invention described herein relates to chromosome conformation profile and 3D architecture as a regulatory modality in its own right, closely linked to the phenotype. The discovery of biomarkers was based on annotations through pattern recognition and screening on representative cohorts of clinical samples representing the differences in phenotypes. We annotated and screened significant parts of the genome, across coding and non-coding parts and over large sways of non-coding 5' and 3' of known genes for identification of statistically disseminating consistent conditional disseminating chromosome conformations, which for example anchor in the non-coding sites within (intronic) or outside of open reading frames.

In selection of the best markers we are driven by statistical data and p values for the marker leads. Selected and validated chromosome conformations within the signature are disseminating stratifying entities in their own right, irrespective of the expression profiles of the genes used in the reference. Further work may be done on relevant regulatory modalities, such as SNPs at the anchoring sites, changes in gene transcription profiles, changes at the level of H3K27ac.

We are taking the question of clinical phenotype differences and their stratification from the basis of fundamental biology and epigenetics controls over phenotype-including for example from the framework of network of regulation. As such, to assist stratification, one can capture changes in the network and it is preferably done through signatures of several biomarkers, for example through following a machine learning algorithm for marker reduction which includes evaluating the optimal number of markers to stratify the testing cohort with minimal noise. This may end with 3-20 markers. Selection of markers for panels may be done by cross-validation statistical performance (and not for example by the functional relevance of the neighbouring genes, used for the reference name). A panel of markers (with names of adjacent genes) is a product of clustered selection from the screening across significant parts of the genome, in non-biased way analysing statistical disseminating powers over 14,000-60,000 annotated EpiSwitch sites across significant parts of the genome. It should not be perceived as a tailored capture of a chromosome conformation on the gene of know functional value for the question of stratification. The total number of sites for chromosome interaction are 1.2 million, and so the potential number of combinations is 1.2 million to the power 1.2 million. The approach that we have followed nevertheless allows the identifying of the relevant chromosome interactions.

The specific markers that are provided by this application have passed selection, being statistically (significantly) associated with the condition. This is what the data in the relevant table demonstrates. Each marker can be seen as representing an event of biological epigenetic as part of network deregulation that is manifested in the relevant condition. In practical terms it means that these markers are prevalent across groups of patients when compared to controls. On average, as an example, an individual marker may typically be present in 80% of patients tested and in 10% of controls tested.

Simple addition of all markers would not represent the network interrelationships between some of the deregulations. This is where the standard multivariate biomarker analysis GLMNET (R package) is brought in. GLMNET package helps to identify interdependence between some of the markers, that reflect their joint role in achieving deregulations leading to disease phenotype. Modelling and then testing markers with highest GLMNET scores offers not only identify the minimal number of markers that accurately identifies the patient cohort, but also the minimal number that offers the least false positive results in the control group of patients, due to background statistical noise of low prevalence in the control group. Typically a group (combination) of selected markers (such as 3 to 10) offers the best balance between both sensitivity and specificity of detection, emerging in the context of multivariate analysis from individual properties of all the selected statistical significant markers for the condition.

The tables herein show the reference names for the array probes (60-mer) for array analysis that overlaps the juncture between the long range interaction sites, the chromosome number and the start and end of two chromosomal fragments that come into juxtaposition.

Specific Aspects

The EpiSwitch™ platform technology detects epigenetic regulatory signatures of regulatory changes between normal and abnormal conditions at loci. The EpiSwitch™ platform identifies and monitors the fundamental epigenetic level of gene regulation associated with regulatory high order structures of human chromosomes also known as chromosome conformation signatures. Chromosome signatures are a distinct primary step in a cascade of gene deregulation. They are high order biomarkers with a unique set of advantages against biomarker platforms that utilize late epigenetic and gene expression biomarkers, such as DNA methylation and RNA profiling.

EpiSwitch™ Array Assay

The custom EpiSwitch™ array-screening platforms come in 4 densities of, 15K, 45K, 100K, and 250K unique chromosome conformations, each chimeric fragment is repeated on the arrays 4 times, making the effective densities 60K, 180K, 400K and 1 Million respectively.

Custom Designed EpiSwitch™ Arrays

The 15K EpiSwitch™ array can screen the whole genome including around 300 loci interrogated with the EpiSwitch™ Biomarker discovery technology. The EpiSwitch™ array is built on the Agilent SurePrint G3 Custom CGH microarray platform; this technology offers 4 densities, 60K, 180K, 400K and 1 Million probes. The density per array is reduced to 15K, 45K, 100K and 250K as each EpiSwitch™ probe is presented as a quadruplicate, thus allowing for statistical evaluation of the reproducibility. The average number of potential EpiSwitch™ markers interrogated per genetic loci is 50; as such the numbers of loci that can be investigated are 300, 900, 2000, and 5000.

EpiSwitch™ Custom Array Pipeline

The EpiSwitch™ array is a dual colour system with one set of samples, after EpiSwitch™ library generation, labelled in Cy5 and the other of sample (controls) to be compared/analyzed labelled in Cy3. The arrays are scanned using the Agilent SureScan Scanner and the resultant features extracted using the Agilent Feature Extraction software. The data is then processed using the EpiSwitch™ array processing scripts in R. The arrays are processed using standard dual colour packages in Bioconductor in R: Limma *. The normalisation of the arrays is done using the normalisedWithinArrays function in Limma * and this is done to the on chip Agilent positive controls and EpiSwitch™ positive controls. The data is filtered based on the Agilent Flag calls, the Agilent control probes are removed and the technical replicate probes are averaged, in order for them to be analysed using Limma *. The probes are modelled based on their difference between the 2 scenarios being compared and then corrected by using False Discovery Rate. Probes with Coefficient of Variation (CV)<=30% that are <=−1.1 or =>1.1 and pass the p<=0.1 FDR p-value are used for further screening. To reduce the probe set further Multiple Factor Analysis is performed using the FactorMineR package in R.

* Note: LIMMA is Linear Models and Empirical Bayes Processes for Assessing Differential Expression in Microarray Experiments. Limma is an R package for the analysis of gene expression data arising from microarray or RNA-Seq.

The pool of probes is initially selected based on adjusted p-value, FC and CV<30% (arbitrary cut off point) parameters for final picking. Further analyses and the final list are drawn based only on the first two parameters (adj. p-value; FC).

Statistical Pipeline

EpiSwitch™ screening arrays are processed using the EpiSwitch™ Analytical Package in R in order to select high value EpiSwitch™ markers for translation on to the EpiSwitch™ PCR platform.

Step 1

Probes are selected based on their corrected p-value (False Discovery Rate, FDR), which is the product of a modified linear regression model. Probes below p-value<=0.1 are selected and then further reduced by their Epigenetic ratio (ER), probes ER have to be <=−1.1 or =>1.1 in order to be selected for further analysis. The last filter is a coefficient of variation (CV), probes have to be below <=0.3.

Step 2

The top 40 markers from the statistical lists are selected based on their ER for selection as markers for PCR translation. The top 20 markers with the highest negative ER load and the top 20 markers with the highest positive ER load form the list.

Step 3

The resultant markers from step 1, the statistically significant probes form the bases of enrichment analysis using hypergeometric enrichment (HE). This analysis enables marker reduction from the significant probe list, and along with the markers from step 2 forms the list of probes translated on to the EpiSwitch™ PCR platform.

The statistical probes are processed by HE to determine which genetic locations have an enrichment of statistically significant probes, indicating which genetic locations are hubs of epigenetic difference.

The most significant enriched loci based on a corrected p-value are selected for probe list generation. Genetic locations below p-value of 0.3 or 0.2 are selected. The statistical probes mapping to these genetic locations, with the markers from step 2, form the high value markers for EpiSwitch™ PCR translation.

Array Design and Processing

Array Design
1. Genetic loci are processed using the SII software (currently v3.2) to:
   a. Pull out the sequence of the genome at these specific genetic loci (gene sequence with 50 kb upstream and 20 kb downstream)
   b. Define the probability that a sequence within this region is involved in CCs
   c. Cut the sequence using a specific RE
   d. Determine which restriction fragments are likely to interact in a certain orientation
   e. Rank the likelihood of different CCs interacting together.
2. Determine array size and therefore number of probe positions available (x)
3. Pull out x/4 interactions.
4. For each interaction define sequence of 30 bp to restriction site from part 1 and 30 bp to restriction site of part 2. Check those regions aren't repeats, if so exclude and take next interaction down on the list. Join both 30 bp to define probe.
5. Create list of x/4 probes plus defined control probes and replicate 4 times to create list to be created on array
6. Upload list of probes onto Agilent Sure design website for custom CGH array.
7. Use probe group to design Agilent custom CGH array.

Array Processing
1. Process samples using EpiSwitch™ Standard Operating Procedure (SOP) for template production.

2. Clean up with ethanol precipitation by array processing laboratory.
3. Process samples as per Agilent SureTag complete DNA labelling kit-Agilent Oligonucleotide Array-based CGH for Genomic DNA Analysis Enzymatic labelling for Blood, Cells or Tissues
4. Scan using Agilent C Scanner using Agilent feature extraction software.

EpiSwitch™ biomarker signatures demonstrate high robustness, sensitivity and specificity in the stratification of complex disease phenotypes. This technology takes advantage of the latest breakthroughs in the science of epigenetics, monitoring and evaluation of chromosome conformation signatures as a highly informative class of epigenetic biomarkers. Current research methodologies deployed in academic environment require from 3 to 7 days for biochemical processing of cellular material in order to detect CCSs. Those procedures have limited sensitivity, and reproducibility; and furthermore, do not have the benefit of the targeted insight provided by the EpiSwitch™ Analytical Package at the design stage.

EpiSwitch™ Array in Silico Marker Identification

CCS sites across the genome are directly evaluated by the EpiSwitch™ Array on clinical samples from testing cohorts for identification of all relevant stratifying lead biomarkers. The EpiSwitch™ Array platform is used for marker identification due to its high-throughput capacity, and its ability to screen large numbers of loci rapidly. The array used was the Agilent custom-CGH array, which allows markers identified through the in silico software to be interrogated.

EpiSwitch™ PCR

Potential markers identified by EpiSwitch™ Array are then validated either by EpiSwitch™ PCR or DNA sequencers (i.e. Roche 454, Nanopore MinION, etc.). The top PCR markers which are statistically significant and display the best reproducibility are selected for further reduction into the final EpiSwitch™ Signature Set, and validated on an independent cohort of samples. EpiSwitch™ PCR can be performed by a trained technician following a standardised operating procedure protocol established. All protocols and manufacture of reagents are performed under ISO 13485 and 9001 accreditation to ensure the quality of the work and the ability to transfer the protocols. EpiSwitch™ PCR and EpiSwitch™ Array biomarker platforms are compatible with analysis of both whole blood and cell lines. The tests are sensitive enough to detect abnormalities in very low copy numbers using small volumes of blood.

Example 1

Identifying Disseminating Individual Chromosome Conformations Specific not Only for Autism Spectrum Disorder, but Also for More Specific Differences in Mild Vs Severe Autism and Healthy Controls Research into causes of ASD has been complicated by the inability of objective biomarker-based identification of biologically meaningful subgroups in the autistic population, with current diagnosis and care being affected by limitations, boundaries and differences between psychiatric, psychological and paediatric approaches. Current diagnostic tools are based on 1) Autism Diagnostic Interview-Revised (ADI-R); 2) Autism Diagnostic Observation Schedule (ADOS); Childhood Autism Rating Scale (CARS), especially for assessment of severity through observation of the child. The Diagnostic interview for social and communicative disorders (DISCO) is also used. In general, social development deficits distinguish autism spectrum disorders from other developmental disorders.

Current medications target ADS symptoms aiming to modulate behavioural treatments in social environment. Psychoactive drugs, anticonvulsants, antidepressants, antipsychotics. For example, antipsychotics risperidone and aripiprazole are FDA approved. Side effects of these treatments: weight gain, drooling, aggressiveness-often outweigh the benefits. Without objective biomarkers linked to biological subtypes of disease deregulation it remains difficult to choose the beneficial medication for individual patient, in the context of personalized medicine.

We have used non-biased full genome screening of blood profiles by chromosome conformations for 12 individual patients clinically annotated as mild ASD, and 12 patients with severe ASD against the averaged profiles of pooled healthy controls.

Detection of chromosome conformations in these comparisons is not driven by any specific genes or any bias or interest in specific genes. Identification of statistically significant chromosome conformations for one of the subgroups identifies regulatory domains of assembled topological autonomous chromosome domains which by nature of 3D architecture affect the regulation of genes captured within range. That will allow an assessment of biological relevance, comparing discovered non-biased systemic biomarkers with biological relevance to ASD for the genes captured through EpiSwitch screening. Physically the targeted sites of chromosome conformation long range interactions/anchoring points always lie within non-coding parts of the genome (including introns). They do not change genomic sequence (i.e. non-genetic by its regulatory nature) and thus does not have immediate relationship with any effect on protein amino acid composition from any of the genes.

FIG. 1 shows the top 200 statistically significant markers present in either mild or severe ASD (against health controls (HC) were identified). These two groups of markers has an overlap-145 markers were statistically significant and were present in both severe and mild ASD when compared to HC. 51 severe ASD markers were unique for severe type. 55 mild ASD markers were unique for mild type.

FIG. 2 show the established significant markers, as chromatin long range domains, the closest coding regions— genes—were identified in multiple scenarios of combinations for overlapping—upstream, downstream, overlapping inside the domain. All these combinations of overlapping with protein coding regions have been shown to have biological examples of how a chromosome conformation domain can affect regulation of a gene.

Markers unique for mild ASD (chromosome conformations either present only in mild ASD, or absent only in ASD) were analysed for genes they potentially would affect by being within their range of regulation. These genes through their protein products were then used in the standard Cytoscape network build up, where the proteins are checked against known systemic databases of protein regulatory networks and pathways. The results show the selected genes under mild ASD deregulation by chromosome conformation conform to the one tight network of known regulatory interactions and several key biological pathways. At the top of the list were the pathway of neuroxins and neuroligins regulation. The Hippo pathway was also identified.

Similar analysis has been done for specific markers against known Transcriptional Factors Binding Sites (TFBS). This was done for markers unique for severe ADS, unique for mild ASD, and common for both severe and mild ASD. The number of significantly enriched TFs for each group is plotted on the VENN diagram in FIG. 3. For example, for markers unique for mild ASD 18 TFs were uniquely enriched, 7+5 TFs were shared with enrichment observed in regions of severe ASD markers, 5+5 TFs were shared with TFs enriched for common shared mild and severe ASD markers, and 5 TFs were shared as enriched for all three groups of ASD makers—mild, severe, shared as common. The identified groups of enriched TFs were used for standard STRING network and pathway enrichment tool to evaluate which regulatory pathways and networks are affected by the three groups of markers through the TFs.

String Network with TFs for unique mild AD markers was enriched for the controls of estrogen signalling and Th17 differentiation. FIG. 4 shows pathway enrichment with TFs for unique mild ASD markers. Please note neurexins and neuroligins, hippo, addictions pathways.

Table 5 shows the same analysis but based not only on chromosome conformation markers uniquely present in mild ASD, but also uniquely absent in mild ASD. Unique presence of the maker has an important practical advantage for the detection test, while unique absence of the marker carries valuable biological insight in term of regulation. The same analysis was done for the markers shared by both mild and severe ASD with IL4, IL13 and Hippo identified.

Table 6 shows the same analysis as Table 5, but for shared (common) ASD markers for both mild and severe. Please note the HPV infection pathway.

A Cytoscape network for severe ASD identified the IL-4 mediated signalling pathway.

Table 7 is a network analysis taking into account all severe ASD unique absent chromosome conformations, not just uniquely present ones.

FIG. 7 is repeat of FIG. 3 as a reminder before String network and enrichment analysis for severe ASD markers String Analysis and Pathway Enrichment through TFs for severe ASD markers identified a viral infection pathway, brain development and estrogen dependent GEX.

FIG. 6 shows a selection of identified mild ASD markers pathways for further analysis. FIG. 7 shows the same, but for severe ASD.

Figure 1:
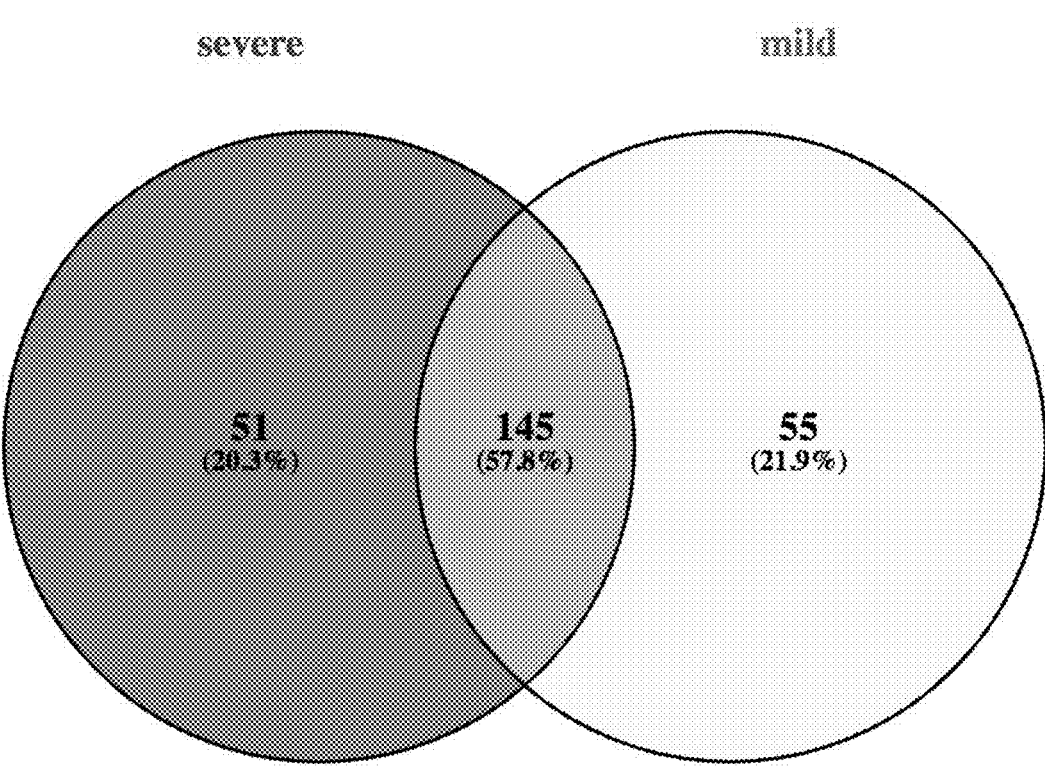
Figure 3:
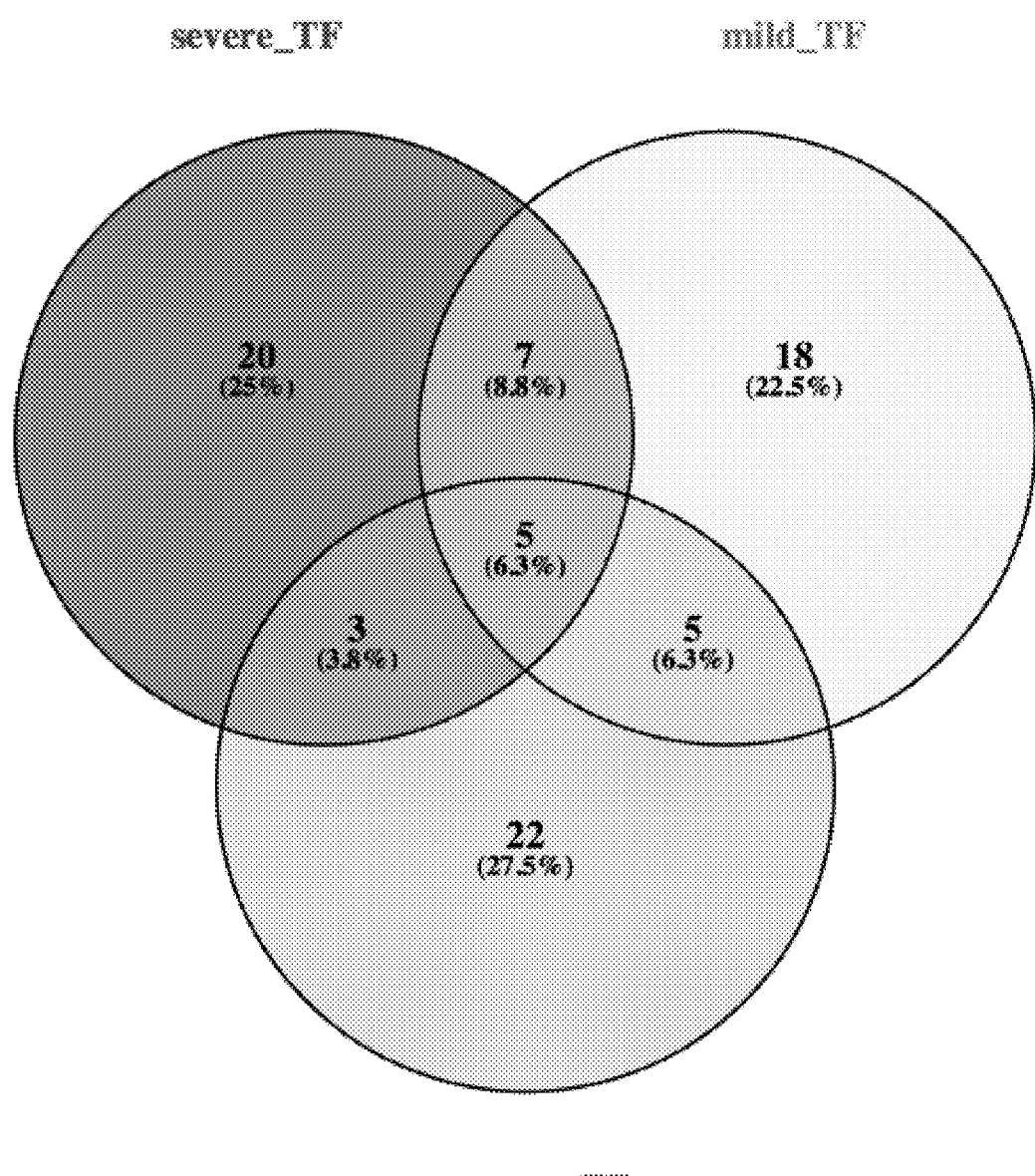
Figure 5:
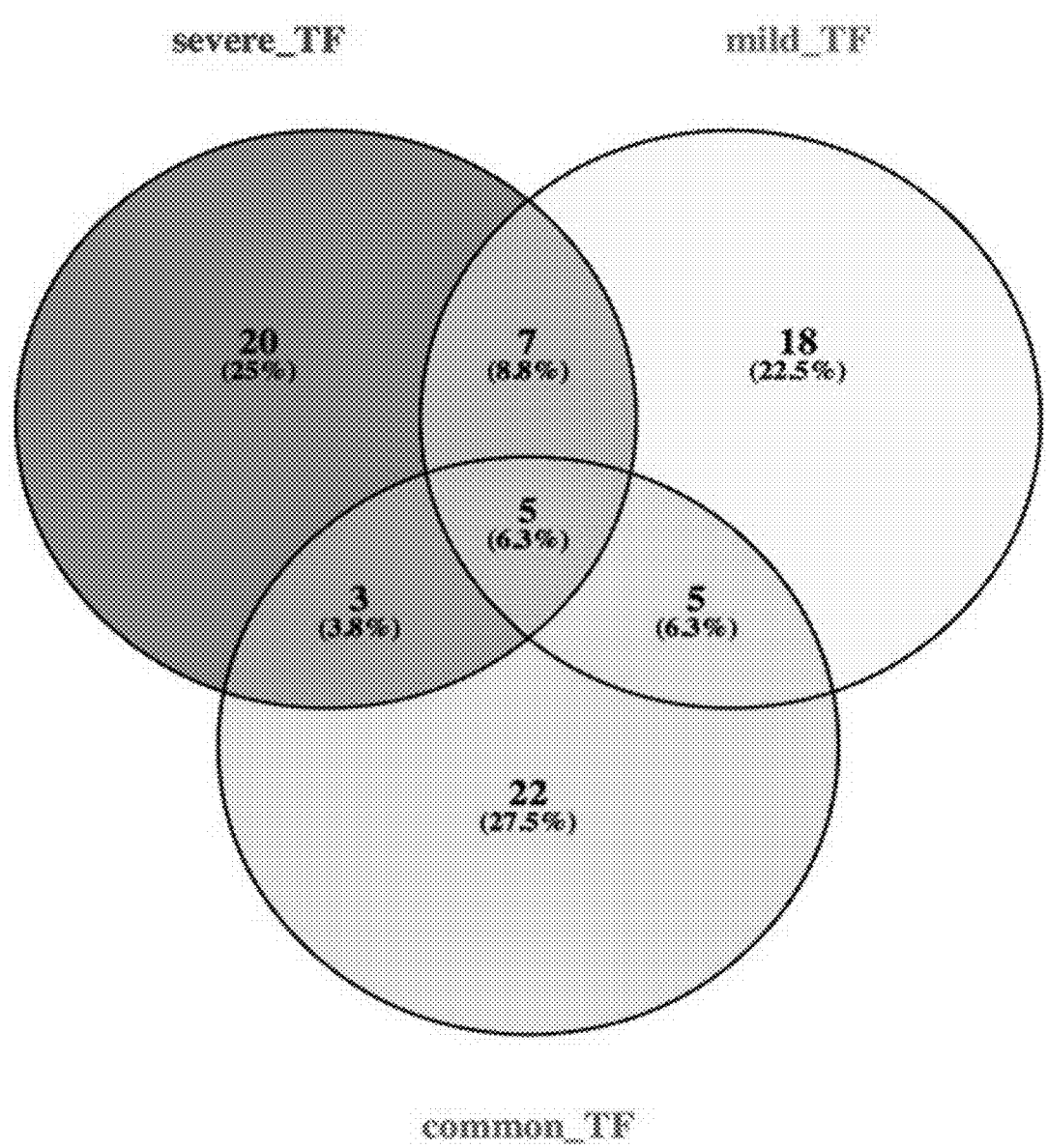
Figure 8:
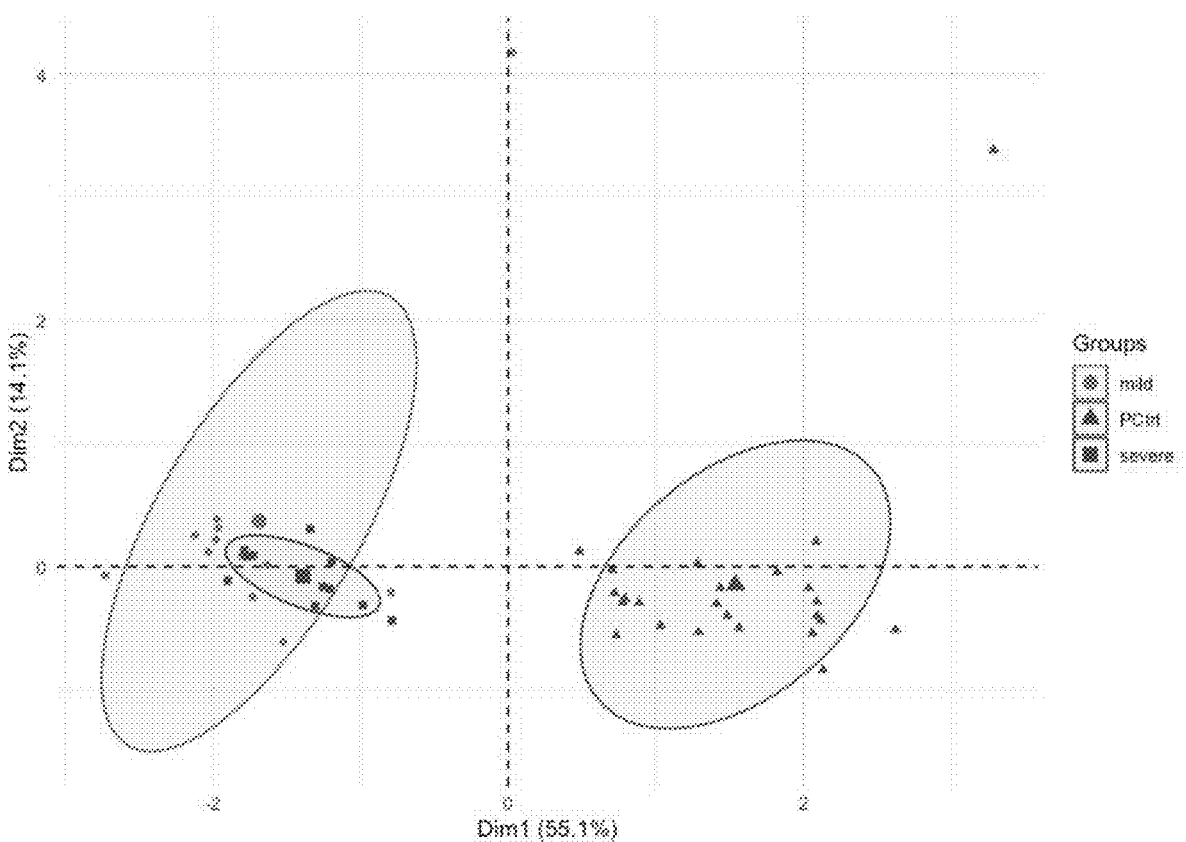

FIG. 8 shows Principal Component Analysis based on Mild Pathway Markers. Left hand large ellipse—mild ASD, left hand small ellipse—severe ASD, right hand ellipse—Healthy Controls. Note complete separation of HC from both types of ASD, with severe ASD driven in a tight group compared to mild ASD—a clear difference in mild and severe ASD profiles from mild ASD marker perspective.

Figure 9:
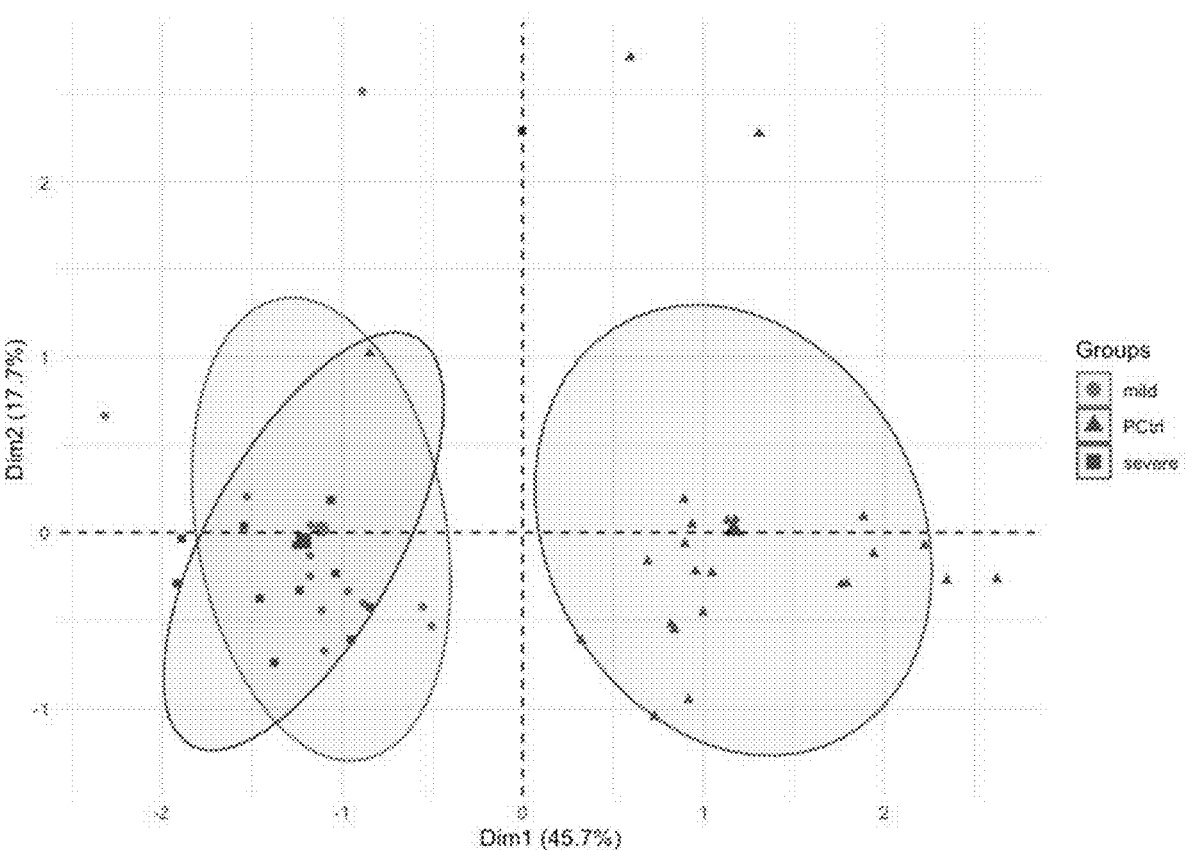

FIG. 9 shows the same analysis but using Severe ASD pathways Markers. Note strong separation of HC (right hand ellipse) from both types of ASD (left hand ellipses).

Genetic location GRIN2A was analysed, where unique significant EpiSwitch™ binary markers for severe or mild ASD, as detected in blood, with reference to the position of peaks for H3K27ac (the peaks themselves are broad and carry background noise), as detected on brain post mortem biopsy. H3K27ac is considered to correlate on certain occasions with elements of 3D chromosome architecture. It was observed retrospectively that non-invasive binary markers correlate with marked peak positions on two occasions. Not all H3K27ac peaks correlate with significant disseminating differences between mild and severe ASD patients.

Tables 8 to 10 provide lists and panels of further markers with particular performance criteria. For Table 10 SHAP values are given, i.e. SHapley Additive explanations. SHAP values show how much each predictor contributes to the target variable.

FIG. 11 shows the network and pathways for markers unique to mild ASD.

FIG. 12 shows enrichment in the network developed on all mild ASD markers.

FIG. 13 shows pathway enrichment for the common ASD markers.

FIG. 14 shows enrichment in a network developed on all common ASD markers.

Figure 15:
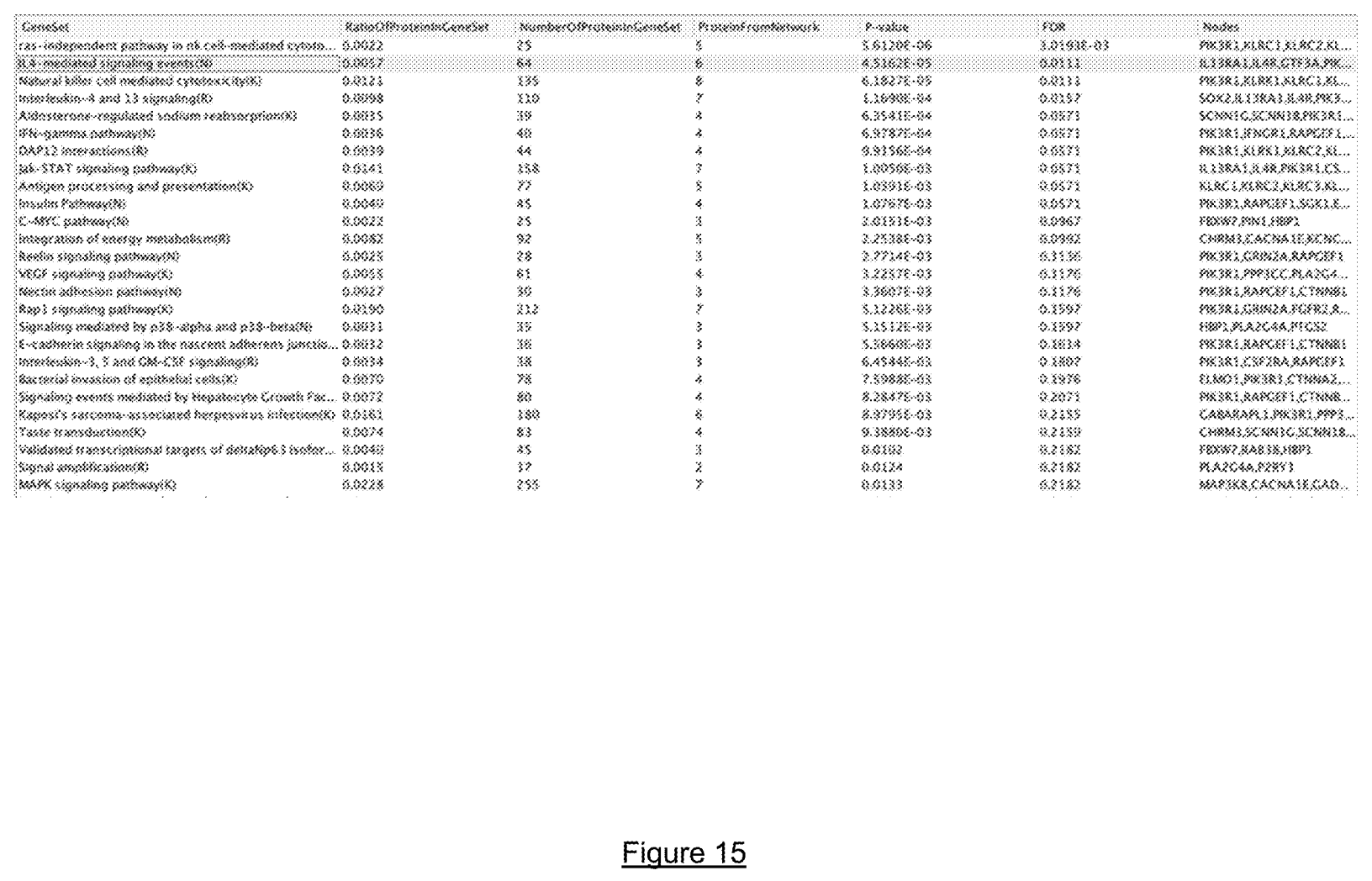

FIG. 15 shows pathways for a network for markers unique for severe ASD.

FIG. 16 shows enrichment in a network developed from markers unique for severe ASD.

FIG. 17 shows enrichment in a network developed for all severe ASD markers.

FIG. 18 shows a TF network built using severe ASD markers.

Figure 19:
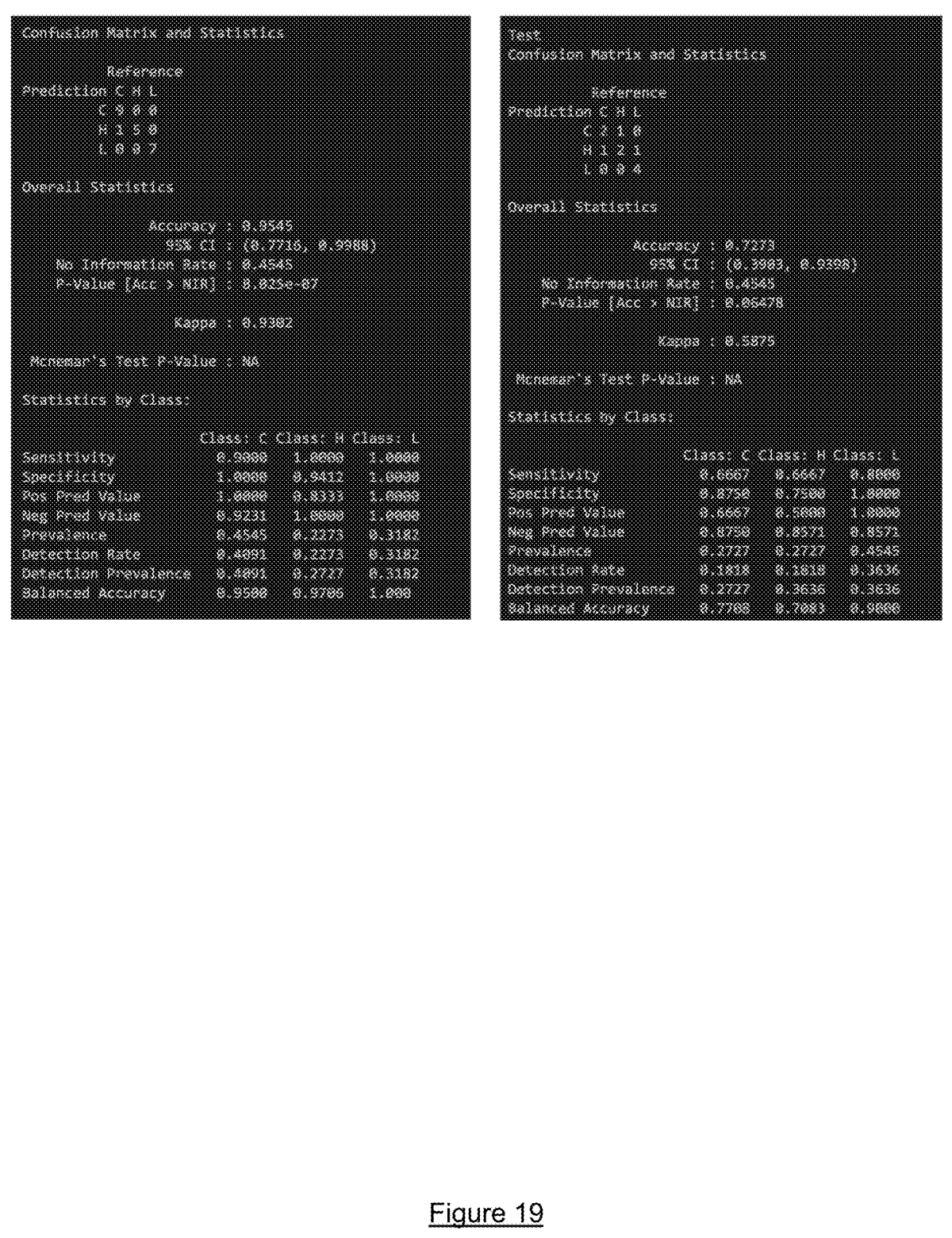

FIG. 19 shows performance characteristics for the markers of Table 10. The training data is on left and testing on the right.

Conclusions

EpiSwitch custom Agilent CGH array whole genome screening provided statistically significant markers which are significant between the groups:
1. Present in healthy controls (HC), but absent in mild and severe ASD
2. Unique of either mild or sever ASD, and absent in HC
3. Common in severe and mild ASD, but absent in HC
4. Unique of absent in either severe or mild ASD In the context of potentially confusing, subjective and contradictory means of identifying and sub-typing patients with ASD, a non-biased total genomic screen at the level of chromosome conformations in blood, as a measurement of systemic non-genetic deregulations associated with ASD, has identified statistically significant non-invasive biomarkers with disseminating powers to distinguish consistently between healthy controls, mild and severe ASD. Analysis of the regions of the genome subjected to identified chromosome conformation controls is con-concordant with biological pathway mechanisms implicated in ASD, with neurological deregulations (neuroxins, etc), addiction, estrogen, HPV infection, and immune system resetting (NK cells). The immune response shows particular presence in the severe ASD subgroup.

TABLE 1.a1

| | Probe | GeneLocus |
|---|---|---|
| 1 | ORF1_13_31010097_31011555_31022136_31024228_FF | HSPH1; TEX26 |
| 2 | ORF1_13_31010097_31011555_31022136_31024228_FF | HSPH1; TEX26 |
| 3 | ORF1_2_227779837_227782633_227875567_227878014_FF | CCL20; DAW1; rs113776284; rs7556897; rs4973341; rs1811711; rs13384448; rs7591163 |
| 4 | ORF1_2_227779837_227782633_227875567_227878014_FF | CCL20; DAW1; rs113776284; rs7556897; rs4973341; rs1811711; rs13384448; rs7591163 |
| 5 | ORF1_8_21022651_21025530_21093029_21096890_RR | rs7015657; rs500816 |
| 6 | ORF1_8_21022651_21025530_21093029_21096890_RR | rs7015657; rs500816 |
| 7 | ORF10_11_49143461_49148959_49212875_49219818_FF | FOLH1; TRIM64C; rs368939818; rs61886492; rs770894245; rs747052707; rs202680; rs202676 |
| 8 | ORF10_11_49143461_49148959_49212875_49219818_FF | FOLH1; TRIM64C; rs368939818; rs61886492; rs770894245; rs747052707; rs202680; rs202676 |
| 9 | ORF10_11_75290920_75295115_75323931_75326829_RR | ARRB1; rs7952044; rs737410 |
| 10 | ORF10_11_75290920_75295115_75323931_75326829_RR | ARRB1; rs7952044; rs737410 |
| 11 | ORF10_13_27276527_27282043_27309940_27312084_RR | RASL11A; rs9512637 |
| 12 | ORF10_13_27276527_27282043_27309940_27312084_RR | RASL11A; rs9512637 |
| 13 | ORF10_2_169020149_169021769_169092304_169105070_FF | ABCB11; DHRS9; rs886043986; rs2161037 |
| 14 | ORF10_2_169020149_169021769_169092304_169105070_FF | ABCB11; DHRS9; rs886043986; rs2161037 |
| 15 | ORF10_4_175807779_175809817_175829279_175833051_FR | GPM6A; rs13144140 |
| 16 | ORF10_4_175807779_175809817_175829279_175833051_FR | GPM6A; rs13144140 |
| 17 | ORF10_5_78549630_78552354_78564492_78567388_RF | LHFPL2; rs72315235; rs344650 |
| 18 | ORF10_5_78549630_78552354_78564492_78567388_RF | LHFPL2; rs72315235; rs344650 |
| 19 | ORF10_9_38681931_38686861_38745325_38749296_FF | ANKRD18A; CNTNAP3 |
| 20 | ORF10_9_38681931_38686861_38745325_38749296_FF | ANKRD18A; CNTNAP3 |
| 21 | ORF100_2_209628749_209631690_209659511_209662054_FF | MAP2; rs146432517; rs9288410 |
| 22 | ORF100_2_209628749_209631690_209659511_209662054_FF | MAP2; rs146432517; rs9288410 |
| 23 | ORF101_6_127085111_127088243_127117219_127121367_RR | RSPO3; rs1936807; rs4580892; rs719726; rs2745349; rs1936792; rs1936797; rs1936799; rs1936800; rs1555091 |
| 24 | ORF101_6_127085111_127088243_127117219_127121367_RR | RSPO3; rs1936807; rs4580892; rs719726; rs2745349; rs1936792; rs1936797; rs1936799; rs1936800; rs1555091 |
| 25 | ORF102_3_179882870_179885277_179956050_179960326_FR | PEX5L; rs146906651 |
| 26 | ORF102_3_179882870_179885277_179956050_179960326_FR | PEX5L; rs146906651 |
| 27 | ORF104_6_159103259_159105928_159122150_159125286_RF | rs2249937; rs9355260 |
| 28 | ORF104_6_159103259_159105928_159122150_159125286_RF | rs2249937; rs9355260 |
| 29 | ORF106_1_152738349_152759424_152785124_152809368_RF | KPRP; LCE1B; LCE1C; LCE1D; LCE1E; LCE1F; rs7517755; rs77199844; rs6701216 |
| 30 | ORF106_1_152738349_152759424_152785124_152809368_RF | KPRP; LCE1B; LCE1C; LCE1D; LCE1E; LCE1F; rs7517755; rs77199844; rs6701216 |
| 31 | ORF106_8_74050342_74056528_74077219_74079715_RR | LY96; rs6472827 |
| 32 | ORF106_8_74050342_74056528_74077219_74079715_RR | LY96; rs6472827 |
| 33 | ORF107_18_10063278_10067780_9946347_9948516_RF | VAPA; rs8089099; rs29067; rs29066 |
| 34 | ORF107_18_10063278_10067780_9946347_9948516_RF | VAPA; rs8089099; rs29067; rs29066 |
| 35 | ORF107_6_140794230_140798634_140883673_140900284_RF | rs146383502; rs11155133 |
| 36 | ORF107_6_140794230_140798634_140883673_140900284_RF | rs11155133 |
| 37 | ORF11_12_10066384_10067858_10157054_10158072_FF | CLEC1A; CLEC7A; OLR1; rs16910526; rs16910527; |

TABLE 1.a1-continued

| Probe | GeneLocus |
|---|---|
|  | rs7309123; rs2078178; rs3901533 |
| 38 ORF11_12_10066384_10067858_10157054_10158072_FF | CLEC1A; CLEC7A; OLR1; rs16910526; rs16910527; rs7309123; rs2078178; rs3901533 |
| 39 ORF11_2_20303337_20304942_20328998_20331608_FR | PUM2; rs111612372 |
| 40 ORF11_2_20303337_20304942_20328998_20331608_FR | PUM2; rs111612372 |
| 41 ORF11_2_216695404_216702694_216719705_216724855_FR | IGFBP2; IGFBP5 |
| 42 ORF11_2_216695404_216702694_216719705_216724855_FR | IGFBP2; IGFBP5 |
| 43 ORF11_4_152216416_152218364_152265231_152270280_FF | FBXW7; rs522743 |
| 44 ORF11_4_152216416_152218364_152265231_152270280_FF | FBXW7; rs522743 |
| 45 ORF11_4_153729106_153731311_153760093_153764783_FF | RNF175; SFRP2 |
| 46 ORF11_4_153729106_153731311_153760093_153764783_FF | RNF175; SFRP2 |
| 47 ORF11_4_153729106_153731311_153764783_153769098_FF | RNF175; SFRP2 |
| 48 ORF11_4_153729106_153731311_153764783_153769098_FF | RNF175; SFRP2 |
| 49 ORF11_5_6223946_6226870_6298491_6302848_FR | rs12518614 |
| 50 ORF11_5_6223946_6226870_6298491_6302848_FR | rs12518614 |
| 51 ORF11_9_38681931_38686861_38758125_38760727_FF | ANKRD18A; CNTNAP3 |
| 52 ORF11_9_38681931_38686861_38758125_38760727_FF | ANKRD18A; CNTNAP3 |

TABLE 1.a2

|  | Probe_Count_Total | Probe_Count_Sig | HyperG_Stats |
|---|---|---|---|
| 1 | 41; 40 | 2; 2; 2; 2 | 0.26460109; 0.271883499; 0.261899069; 0.269983451 |
| 2 | 41; 40 | 2; 2; 2; 2 | 0.26460109; 0.271883499; 0.261899069; 0.269983451 |
| 3 | 52; 38 | 1; 1; 2; 1 | 0.266738689; 0.244043749; 0.255573168; 0.325888812 |
| 4 | 52; 38 | 1; 1; 2; 1 | 0.266738689; 0.244043749; 0.255573168; 0.325888812 |
| 5 | NA | NA | NA |
| 6 | NA | NA | NA |
| 7 | 25; 22 | 3; 4; 1; 2 | 0.05677955; 0.016055763; 0.372324987; 0.173304212 |
| 8 | 25; 22 | 3; 4; 1; 2 | 0.05677955; 0.016055763; 0.372324987; 0.173304212 |
| 9 | 27 | 1; 1 | 0.374553651; 0.37173223 |
| 10 | 27 | 1; 1 | 0.374553651; 0.37173223 |
| 11 | 136 | 1; 1 | 0.024430673; 0.016981585 |
| 12 | 136 | 1; 1 | 0.024430673; 0.016981585 |
| 13 | 28; 49 | 2; 2; 2; 3 | 0.204457601; 0.219149094; 0.276096976; 0.190339907 |
| 14 | 28; 49 | 2; 2; 2; 3 | 0.204457601; 0.219149094; 0.276096976; 0.190339907 |
| 15 | 68 | 3; 4 | 0.224345313; 0.163371308 |
| 16 | 68 | 3; 4 | 0.224345313; 0.163371308 |
| 17 | 32 | 1; 1 | 0.363856051; 0.35529211 |
| 18 | 32 | 1; 1 | 0.363856051; 0.35529211 |
| 19 | 21; 8 | 8; 8; 8; 8 | 6.3e−07; 1.12e−06; 5.16e−12; 9.55e−12 |
| 20 | 21; 8 | 8; 8; 8; 8 | 6.3e−07; 1.12e−06; 5.16e−12; 9.55e−12 |
| 21 | 60 | 5; 7 | 0.05512946; 0.009185497 |
| 22 | 60 | 5; 7 | 0.05512946; 0.009185497 |
| 23 | 7 | 1; 1 | 0.215038813; 0.227740664 |
| 24 | 7 | 1; 1 | 0.215038813; 0.227740664 |
| 25 | 9 | 1; 1 | 0.255358235; 0.268692312 |
| 26 | 9 | 1; 1 | 0.255358235; 0.268692312 |
| 27 | NA | NA | NA |
| 28 | NA | NA | NA |
| 29 | 5; 14; 14; 14; 14; 12 | 1; 1; 1; 1; 1; 1; 1; 1; 1; 1; 1 | 0.166301763; 0.177271291; 0.325643034; 0.337131196; 0.325643034; 0.337131196; 0.325643034; 0.337131196; 0.325643034; 0.337131196; 0.302214299; 0.314913912 |
| 30 | 5; 14; 14; 14; 14; 12 | 1; 1; 1; 1; 1; 1; 1; 1; 1; 1; 1 | 0.166301763; 0.177271291; 0.325643034; 0.337131196; 0.325643034; 0.337131196; 0.325643034; 0.337131196; 0.325643034; 0.337131196; 0.302214299; 0.314913912 |
| 31 | 29 | 2; 2 | 0.211050406; 0.22548219 |
| 32 | 29 | 2; 2 | 0.211050406; 0.22548219 |
| 33 | 111 | 2; 2 | 0.12134432; 0.099229264 |
| 34 | 111 | 2; 2 | 0.12134432; 0.099229264 |
| 35 | NA | NA | NA |
| 36 | NA | NA | NA |
| 37 | 44; 68; 79 | 2; 2; 2; 2; 2; 3 | 0.270943694; 0.275697963; 0.251156755; 0.236353672; 0.219227; 0.224909805 |
| 38 | 44; 68; 79 | 2; 2; 2; 2; 2; 3 | 0.270943694; 0.275697963; 0.251156755; 0.236353672; 0.219227; 0.224909805 |
| 39 | 54 | 5; 6 | 0.040491239; 0.018151611 |
| 40 | 54 | 5; 6 | 0.040491239; 0.018151611 |
| 41 | 27; 73 | 1; 1; 1; 1 | 0.374553651; 0.37173223; 0.162201186; 0.138576645 |
| 42 | 27; 73 | 1; 1; 1; 1 | 0.374553651; 0.37173223; 0.162201186; 0.138576645 |
| 43 | 143 | 3; 2 | 0.107765005; 0.041422991 |
| 44 | 143 | 3; 2 | 0.107765005; 0.041422991 |
| 45 | 22; 13 | 2; 3; 2; 2 | 0.158567173; 0.050708849; 0.076537269; 0.086128906 |
| 46 | 22; 13 | 2; 3; 2; 2 | 0.158567173; 0.050708849; 0.076537269; 0.086128906 |
| 47 | 22; 13 | 2; 3; 2; 2 | 0.158567173; 0.050708849; 0.076537269; 0.086128906 |

TABLE 1.a2-continued

| | Probe_Count_Total | Probe_Count_Sig | HyperG_Stats |
|---|---|---|---|
| 48 | 22; 13 | 2; 3; 2; 2 | 0.158567173; 0.050708849; 0.076537269; 0.086128906 |
| 49 | NA | NA | NA |
| 50 | NA | NA | NA |
| 51 | 21; 8 | 8; 8; 8; 8 | 6.3e−07; 1.12e−06; 5.16e−12; 9.55e−12 |
| 52 | 21; 8 | 8; 8; 8; 8 | 6.3e−07; 1.12e−06; 5.16e−12; 9.55e−12 |

TABLE 1.a3

| | FDR_HyperG | Percent_Sig | logFC | AveExpr |
|---|---|---|---|---|
| 1 | 0.375519541; 0.376115439; 0.375519541; 0.376115439 | 4.88; 4.88; 5; 5 | 0.868612787 | 0.868612787 |
| 2 | 0.375519541; 0.376115439; 0.375519541; 0.376115439 | 4.88; 4.88; 5; 5 | 0.598904033 | 0.598904033 |
| 3 | 0.375519541; 0.376115439; 0.375519541; 0.376115439 | 1.92; 1.92; 5.26; 2.63 | 0.62710618 | 0.62710618 |
| 4 | 0.375519541; 0.376115439; 0.375519541; 0.376115439 | 1.92; 1.92; 5.26; 2.63 | 0.530641835 | 0.530641835 |
| 5 | NA | NA | 0.7513734 | 0.7513734 |
| 6 | NA | NA | 0.747960815 | 0.747960815 |
| 7 | 0.375519541; 0.376115439; 0.375519541; 0.376115439 | 12; 16; 4.55; 9.09 | 0.674825025 | 0.674825025 |
| 8 | 0.375519541; 0.376115439; 0.375519541; 0.376115439 | 12; 16; 4.55; 9.09 | 0.65954888 | 0.65954888 |
| 9 | 0.375519541; 0.376115439 | 3.7; 3.7 | 0.602294433 | 0.602294433 |
| 10 | 0.375519541; 0.376115439 | 3.7; 3.7 | 0.595906629 | 0.595906629 |
| 11 | 0.375519541; 0.376115439 | 0.74; 0.74 | 0.555587425 | 0.555587425 |
| 12 | 0.375519541; 0.376115439 | 0.74; 0.74 | 0.550786641 | 0.550786641 |
| 13 | 0.375519541; 0.376115439; 0.375519541; 0.376115439 | 7.14; 7.14; 4.08; 6.12 | 0.938628219 | 0.938628219 |
| 14 | 0.375519541; 0.376115439; 0.375519541; 0.376115439 | 7.14; 7.14; 4.08; 6.12 | 0.755897322 | 0.755897322 |
| 15 | 0.375519541; 0.376115439 | 4.41; 5.88 | 0.650827971 | 0.650827971 |
| 16 | 0.375519541; 0.376115439 | 4.41; 5.88 | 0.561812306 | 0.561812306 |
| 17 | 0.375519541; 0.376115439 | 3.12; 3.12 | 0.7178366 | 0.7178366 |
| 18 | 0.375519541; 0.376115439 | 3.12; 3.12 | 0.664533836 | 0.664533836 |
| 19 | 0.000109745; 0.00028483; 1.35e−09; 4.87e−09 | 38.1; 38.1; 100; 100 | 0.720345164 | 0.720345164 |
| 20 | 0.000109745; 0.00028483; 1.35e−09; 4.87e−09 | 38.1; 38.1; 100; 100 | 0.585763865 | 0.585763865 |
| 21 | 0.375519541; 0.275564898 | 8.33; 11.67 | 0.728255496 | 0.728255496 |
| 22 | 0.375519541; 0.275564898 | 8.33; 11.67 | 0.626985795 | 0.626985795 |
| 23 | 0.375519541; 0.376115439 | 14.29; 14.29 | 0.805818181 | 0.805818181 |
| 24 | 0.375519541; 0.376115439 | 14.29; 14.29 | 0.754843188 | 0.754843188 |
| 25 | 0.375519541; 0.376115439 | 11.11; 11.11 | 0.569380297 | 0.569380297 |
| 26 | 0.375519541; 0.376115439 | 11.11; 11.11 | 0.500263031 | 0.500263031 |
| 27 | NA | NA | 0.509897575 | 0.509897575 |
| 28 | NA | NA | 0.50657948 | 0.50657948 |
| 29 | 0.375519541; 0.376115439; 0.375519541; 0.376115439; 0.375519541; 0.376115439; 0.375519541; 0.376115439; 0.375519541; 0.375519541; 0.376115439 | 20; 20; 7.14; 7.14; 7.14; 7.14; 7.14; 7.14; 7.14; 7.14; 8.33; 8.33 | 0.866207217 | 0.866207217 |
| 30 | 0.375519541; 0.376115439; 0.375519541; 0.376115439; 0.375519541; 0.376115439; 0.375519541; 0.376115439; 0.375519541; 0.375519541; 0.376115439 | 20; 20; 7.14; 7.14; 7.14; 7.14; 7.14; 7.14; 7.14; 7.14; 8.33; 8.33 | 0.796884387 | 0.796884387 |
| 31 | 0.375519541; 0.376115439 | 6.9; 6.9 | 0.676235261 | 0.676235261 |
| 32 | 0.375519541; 0.376115439 | 6.9; 6.9 | 0.65992899 | 0.65992899 |
| 33 | 0.375519541; 0.376115439 | 1.8; 1.8 | 0.537783958 | 0.537783958 |
| 34 | 0.375519541; 0.376115439 | 1.8; 1.8 | 0.525514832 | 0.525514832 |
| 35 | NA | NA | 0.613602351 | 0.613602351 |
| 36 | NA | NA | 0.577796521 | 0.577796521 |
| 37 | 0.375519541; 0.376115439; 0.375519541; 0.376115439; 0.375519541; 0.376115439 | 4.55; 4.55; 2.94; 2.94; 2.53; 3.8 | 0.850834682 | 0.850834682 |
| 38 | 0.375519541; 0.376115439; 0.375519541; 0.376115439; 0.375519541; 0.376115439 | 4.55; 4.55; 2.94; 2.94; 2.53; 3.8 | 0.799471663 | 0.799471663 |
| 39 | 0.375519541; 0.376115439 | 9.26; 11.11 | 0.700295531 | 0.700295531 |
| 40 | 0.375519541; 0.376115439 | 9.26; 11.11 | 0.659362838 | 0.659362838 |
| 41 | 0.375519541; 0.376115439; 0.375519541; 0.376115439 | 3.7; 3.7; 1.37; 1.37 | 0.604361909 | 0.604361909 |
| 42 | 0.375519541; 0.376115439; 0.375519541; 0.376115439 | 3.7; 3.7; 1.37; 1.37 | 0.538807176 | 0.538807176 |
| 43 | 0.375519541; 0.376115439 | 2.1; 1.4 | 0.517282981 | 0.517282981 |
| 44 | 0.375519541; 0.376115439 | 2.1; 1.4 | 0.507863493 | 0.507863493 |
| 45 | 0.375519541; 0.376115439; 0.375519541; 0.376115439 | 9.09; 13.64; 15.38; 15.38 | 0.64156671 | 0.64156671 |
| 46 | 0.375519541; 0.376115439; 0.375519541; | 9.09; 13.64; 15.38; 15.38 | 0.573819811 | 0.573819811 |

TABLE 1.a3-continued

|    | FDR_HyperG | Percent_Sig | logFC | AveExpr |
|----|------------|-------------|-------|---------|
|    | 0.376115439 | | | |
| 47 | 0.375519541; 0.376115439; 0.375519541; 0.376115439 | 9.09; 13.64; 15.38; 15.38 | 0.652146396 | 0.652146396 |
| 48 | 0.375519541; 0.376115439; 0.375519541; 0.376115439 | 9.09; 13.64; 15.38; 15.38 | 0.555942825 | 0.555942825 |
| 49 | NA | NA | 0.609340305 | 0.609340305 |
| 50 | NA | NA | 0.59761426 | 0.59761426 |
| 51 | 0.000109745; 0.00028483; 1.3509; 4.87e−09 | 38.1; 38.1; 100; 100 | 0.677345043 | 0.677345043 |
| 52 | 0.000109745; 0.00028483; 1.35e−09; 4.87e−09 | 38.1; 38.1; 100; 100 | 0.57758614 | 0.57758614 |

TABLE 1.a4

|    | t | P.Value | adj.P.Val | B | FC | FC_1 | LS |
|----|---|---------|-----------|---|-----|------|-----|
| 1 | 15.48213629 | 0.00000000290 | 0.00000295 | 11.76634134 | 1.825906369 | 1.825906369 | 1 |
| 2 | 10.90560599 | 0.000000141 | 0.0000121 | 7.993827062 | 1.514565565 | 1.514565565 | 1 |
| 3 | 14.54112017 | 0.00000000592 | 0.00000425 | 11.09715078 | 1.544463932 | 1.544463932 | 1 |
| 4 | 12.04390392 | 0.0000000472 | 0.00000648 | 9.09410211 | 1.444571722 | 1.444571722 | 1 |
| 5 | 25.72439074 | 0.00000000000747 | 0.00000021 | 17.12798872 | 1.683394607 | 1.683394607 | 1 |
| 6 | 12.9172327 | 0.0000000225 | 0.00000846 | 9.819863175 | 1.679417371 | 1.679417371 | 1 |
| 7 | 12.13583206 | 0.0000000433 | 0.00000621 | 9.17851343 | 1.596403143 | 1.596403143 | 1 |
| 8 | 6.326625846 | 0.0000389 | 0.000771167 | 2.314278452 | 1.579588621 | 1.579588621 | 1 |
| 9 | 11.19275614 | 0.000000106 | 0.0000101 | 8.281365671 | 1.518129049 | 1.518129049 | 1 |
| 10 | 14.86623147 | 0.00000000460 | 0.00000374 | 11.3338263 | 1.511422107 | 1.511422107 | 1 |
| 11 | 9.97024001 | 0.000000387 | 0.0000415 | 7.010942014 | 1.469766959 | 1.469766959 | 1 |
| 12 | 7.304237986 | 0.0000095 | 0.000168592 | 3.689574847 | 1.464884218 | 1.464884218 | 1 |
| 13 | 5.188268027 | 0.000230155 | 0.002611351 | 0.486477599 | 1.916704881 | 1.916704881 | 1 |
| 14 | 7.96757943 | 0.00000396 | 0.0000951 | 4.592800505 | 1.688681585 | 1.688681585 | 1 |
| 15 | 8.406146792 | 0.00000234 | 0.000126067 | 5.19109577 | 1.570069009 | 1.570069009 | 1 |
| 16 | 9.176454561 | 0.00000091 | 0.0000738 | 6.102024196 | 1.47612235 | 1.47612235 | 1 |
| 17 | 10.68763964 | 0.000000176 | 0.0000138 | 7.770816129 | 1.644713846 | 1.644713846 | 1 |
| 18 | 7.604376575 | 0.0000065 | 0.000238672 | 4.149051664 | 1.585056027 | 1.585056027 | 1 |
| 19 | 5.982165578 | 0.0000653 | 0.001097327 | 1.780661324 | 1.647576169 | 1.647576169 | 1 |
| 20 | 6.985570256 | 0.0000148 | 0.00022515 | 3.235258081 | 1.500833427 | 1.500833427 | 1 |
| 21 | 11.11001278 | 0.000000119 | 0.0000206 | 8.182990839 | 1.656634681 | 1.656634681 | 1 |
| 22 | 14.50519177 | 0.00000000581 | 0.00000221 | 11.15480936 | 1.544335061 | 1.544335061 | 1 |
| 23 | 15.37164789 | 0.000000003 | 0.00000157 | 11.79292692 | 1.748136914 | 1.748136914 | 1 |
| 24 | 13.21152003 | 0.0000000175 | 0.00000747 | 10.06384086 | 1.687448167 | 1.687448167 | 1 |
| 25 | 3.215141267 | 0.007467378 | 0.029467513 | −3.045565381 | 1.483886037 | 1.483886037 | 1 |
| 26 | 2.948006208 | 0.012206989 | 0.030334629 | −3.634544291 | 1.414471424 | 1.414471424 | 1 |
| 27 | 8.348609612 | 0.00000251 | 0.000132277 | 5.118936878 | 1.423949097 | 1.423949097 | 1 |
| 28 | 9.450440119 | 0.000000665 | 0.0000309 | 6.42147295 | 1.420677881 | 1.420677881 | 1 |
| 29 | 17.02141727 | 0.000000000928 | 0.000000911 | 12.90295478 | 1.822864364 | 1.822864364 | 1 |
| 30 | 10.01427596 | 0.000000369 | 0.0000403 | 7.058479282 | 1.737345139 | 1.737345139 | 1 |
| 31 | 12.30252086 | 0.0000000372 | 0.00000569 | 9.329970688 | 1.597964392 | 1.597964392 | 1 |
| 32 | 14.06352468 | 0.00000000863 | 0.00000511 | 10.73843464 | 1.580004854 | 1.580004854 | 1 |
| 33 | 7.952019371 | 0.00000404 | 0.0000963 | 4.572250314 | 1.451740867 | 1.451740867 | 1 |
| 34 | 7.231237094 | 0.0000107 | 0.000330369 | 3.636164955 | 1.439447161 | 1.439447161 | 1 |
| 35 | 15.15831191 | 0.00000000369 | 0.00000351 | 11.54146845 | 1.530074979 | 1.530074979 | 1 |
| 36 | 18.45463633 | 0.000000000364 | 0.000000599 | 13.76937805 | 1.492567856 | 1.492567856 | 1 |
| 37 | 9.704773837 | 0.000000517 | 0.0000497 | 6.720302935 | 1.803544078 | 1.803544078 | 1 |
| 38 | 11.49090413 | 0.0000000795 | 0.00000863 | 8.572631871 | 1.740463626 | 1.740463626 | 1 |
| 39 | 11.48453583 | 0.000000083 | 0.0000165 | 8.543169301 | 1.624837601 | 1.624837601 | 1 |
| 40 | 11.05061974 | 0.000000122 | 0.000011 | 8.139913014 | 1.579384939 | 1.579384939 | 1 |
| 41 | 10.20129572 | 0.000000302 | 0.0000361 | 7.258274228 | 1.520306187 | 1.520306187 | 1 |
| 42 | 11.03643039 | 0.000000124 | 0.0000111 | 8.12569815 | 1.452770866 | 1.452770866 | 1 |
| 43 | 19.27838714 | 0.000000000219 | 0.000000503 | 14.23104616 | 1.43125723 | 1.43125723 | 1 |
| 44 | 12.12361632 | 0.0000000456 | 0.000012 | 9.1316772 | 1.42194286 | 1.42194286 | 1 |
| 45 | 10.64291847 | 0.000000191 | 0.0000275 | 7.716972128 | 1.560022363 | 1.560022363 | 1 |
| 46 | 9.673151208 | 0.000000519 | 0.0000266 | 6.675396652 | 1.488459339 | 1.488459339 | 1 |
| 47 | 11.98349768 | 0.0000000519 | 0.0000129 | 9.005365404 | 1.571504492 | 1.571504492 | 1 |
| 48 | 8.403692855 | 0.00000229 | 0.0000672 | 5.156809921 | 1.470129073 | 1.470129073 | 1 |
| 49 | 8.55926631 | 0.00000189 | 0.0000595 | 5.352541561 | 1.525561463 | 1.525561463 | 1 |
| 50 | 13.03017616 | 0.0000000204 | 0.00000803 | 9.91419092 | 1.513212144 | 1.513212144 | 1 |
| 51 | 5.77751212 | 0.0000896 | 0.001355138 | 1.455590078 | 1.599194087 | 1.599194087 | 1 |
| 52 | 6.932319235 | 0.0000159 | 0.000237022 | 3.158007229 | 1.492350217 | 1.492350217 | 1 |

TABLE 1.a5

| Loop | Detected | Probe sequence 60 mer | Probe Location Chr |
|---|---|---|---|
| 1 | mHC | GAAACAGAATTTCAAAAGGATACTATATTCGATTGATACATGAGTTTTAGTATTTTTTGA (SEQ ID NO: 2) | 13 |
| 2 | sHC | GAAACAGAATTTCAAAAGGATACTATATTCGATTGATACATGAGTTTTAGTATTTTTTGA (SEQ ID NO: 2) | 13 |
| 3 | mHC | GCATTGTTTCTTCATTTTATTTTATTTTTCGAAGTCTTCAAGCTGACTACTAAAAATTGG (SEQ ID NO: 4) | 2 |
| 4 | sHC | GCATTGTTTCTTCATTTTATTTTATTTTTCGAAGTCTTCAAGCTGACTACTAAAAATTGG (SEQ ID NO: 4) | 2 |
| 5 | sHC | CAGTAATCCTAGAAAGACAACTGATACATCGATTTTCATTTGAAATCTTTCTAATATTCC (SEQ ID NO: 6) | 8 |
| 6 | mHC | CAGTAATCCTAGAAAGACAACTGATACATCGATTTTCATTTGAAATCTTTCTAATATTCC (SEQ ID NO: 6) | 8 |
| 7 | sHC | ATTTTTTTTTATTATTATACTTTTAAGTTCGAGCTTTTTGATAAAATTTGAAAAACACAT (SEQ ID NO: 8) | 11 |
| 8 | mHC | ATTTTTTTTTATTATTATACTTTTAAGTTCGAGCTTTTTGATAAAATTTGAAAAACACAT (SEQ ID NO: 8) | 11 |
| 9 | sHC | ATAATAAACAAGCAAAATATGTGTACATTCGAGATACTACGAGTTAATAGCATAGGAGAT (SEQ ID NO: 10) | 11 |
| 10 | mHC | ATAATAAACAAGCAAAATATGTGTACATTCGAGATACTACGAGTTAATAGCATAGGAGAT (SEQ ID NO: 10) | 11 |
| 11 | mHC | TATTATAATTGACTTATTTTTCCATTATTCGAATACATTTTTCTCTTTGAGTGGGAAGAA (SEQ ID NO: 12) | 13 |
| 12 | sHC | TATTATAATTGACTTATTTTTCCATTATTCGAATACATTTTTCTCTTTGAGTGGGAAGAA (SEQ ID NO: 12) | 13 |
| 13 | mHC | TATATTTAATTATAATTGTAACACAATGTCGATATTGAATGACTTCATGTTGTGAAGTTG (SEQ ID NO: 14) | 2 |
| 14 | sHC | TATATTTAATTATAATTGTAACACAATGTCGATATTGAATGACTTCATGTTGTGAAGTTG (SEQ ID NO: 14) | 2 |
| 15 | mHC | AATGCTTAAACACCAAGTATATATATTTTCGATATAGTTTAGTTATAACCATAATCATAT (SEQ ID NO: 16) | 4 |
| 16 | sHC | AATGCTTAAACACCAAGTATATATATTTTCGATATAGTTTAGTTATAACCATAATCATAT (SEQ ID NO: 16) | 4 |
| 17 | sHC | TTTTCATTTTTTTTTAAATATGCTATTTCGATTTTCTTTCATCAGGAGTAAGTTTATAG (SEQ ID NO: 18) | 5 |
| 18 | mHC | TTTTCATTTTTTTTTAAATATGCTATTTCGATTTTCTTTCATCAGGAGTAAGTTTATAG (SEQ ID NO: 18) | 5 |
| 19 | mHC | CCACGGAGGGGTCCTTCTGAACTGCAATTCGATGTTACTCTGGAAACAAAGGTCCCCTTG (SEQ ID NO: 20) | 9 |
| 20 | sHC | CCACGGAGGGGTCCTTCTGAACTGCAATTCGATGTTACTCTGGAAACAAAGGTCCCCTTG (SEQ ID NO: 20) | 9 |
| 21 | mHC | ATATGAAACCAAATATATAAACTTATTTTCGATTAAGAATTACCGTCTTAAGAAAATCTC (SEQ ID NO: 22) | 2 |
| 22 | sHC | ATATGAAACCAAATATATAAACTTATTTTCGATTAAGAATTACCGTCTTAAGAAAATCTC (SEQ ID NO: 22) | 2 |
| 23 | sHC | ATTTTTTTTAGCCCTATCTTCACAGGTATCGACTAAATACTTCTTCAGTAATTACTGAAA (SEQ ID NO: 24) | 6 |
| 24 | mHC | ATTTTTTTTAGCCCTATCTTCACAGGTATCGACTAAATACTTCTTCAGTAATTACTGAAA (SEQ ID NO: 24) | 6 |
| 25 | mHC | ATATTACCTTATTTGGAAACAGTTTCATTCGAGTGGCTCAAATGATTATTTTTATAGTTT (SEQ ID NO: 26) | 3 |
| 26 | sHC | ATATTACCTTATTTGGAAACAGTTTCATTCGAGTGGCTCAAATGATTATTTTTATAGTTT | 3 |

TABLE 1.a5-continued

| Loop Detected | Probe sequence 60 mer | Probe Location Chr |
|---|---|---|
| | (SEQ ID NO: 26) | |
| 27 mHC | ACTTGCTTCTATAAACATTATTGTAAGATCGAGACTCAAAATCATTTGACTCTTCTACAA (SEQ ID NO: 28) | 6 |
| 28 sHC | ACTTGCTTCTATAAACATTATTGTAAGATCGAGACTCAAAATCATTTGACTCTTCTACAA (SEQ ID NO: 28) | 6 |
| 29 sHC | CTATAGAAATTAAAATAATATTAAGAGTTCGATTATTCTGCTATACTTTTCTCATTATAA (SEQ ID NO: 30) | 1 |
| 30 mHC | CTATAGAAATTAAAATAATATTAAGAGTTCGATTATTCTGCTATACTTTTCTCATTATAA (SEQ ID NO: 30) | 1 |
| 31 sHC | ACTAAATTTATTTTAACTTTTTTTTTAATCGAGAGTTTTTATAGCACTTACTCTGAGTCT (SEQ ID NO: 32) | 8 |
| 32 mHC | ACTAAATTTATTTTAACTTTTTTTTTAATCGAGAGTTTTTATAGCACTTACTCTGAGTCT (SEQ ID NO: 32) | 8 |
| 33 sHC | ATGTAAAGAATTTAAAAATAATCAGTTGTCGAGATTATTTTTCAATTTTGGGTGCTCTTC (SEQ ID NO: 34) | 18 |
| 34 mHC | ATGTAAAGAATTTAAAAATAATCAGTTGTCGAGATTATTTTTCAATTTTGGGTGCTCTTC (SEQ ID NO: 34) | 18 |
| 35 mHC | TACCTTTAACAAAATTCTCTAGACTTTTTCGATTTACATTCTGTTGTTTCATTGCATTAT (SEQ ID NO: 36) | 6 |
| 36 sHC | TACCTTTAACAAAATTCTCTAGACTTTTTCGATTTACATTCTGTTGTTTCATTGCATTAT (SEQ ID NO: 36) | 6 |
| 37 mHC | ATATTGGTAGAATAATAGTAGATACTATTCGAATGGTATATCCTCATAGTTTTAATCTGT (SEQ ID NO: 38) | 12 |
| 38 sHC | ATATTGGTAGAATAATAGTAGATACTATTCGAATGGTATATCCTCATAGTTTTAATCTGT (SEQ ID NO: 38) | 12 |
| 39 mHC | TATATGGTACATATTATACATATTTCTATCGATTTTTACAAGAAATTTAAAAATTAGCTT (SEQ ID NO: 40) | 2 |
| 40 sHC | TATATGGTACATATTATACATATTTCTATCGATTTTTACAAGAAATTTAAAAATTAGCTT (SEQ ID NO: 40) | 2 |
| 41 mHC | ATCCAGATGACCTAAAATATGTTTATTTTCGAAACAATCTCATTTGACAGATGAAGAAAC (SEQ ID NO: 42) | 2 |
| 42 sHC | ATCCAGATGACCTAAAATATGTTTATTTTCGAAACAATCTCATTTGACAGATGAAGAAAC (SEQ ID NO: 42) | 2 |
| 43 sHC | AACTCTGTATTTTCTTTTGTAAGATTCATCGATCAATAAATCTTTAATCACATTCACAAA (SEQ ID NO: 44) | 4 |
| 44 mHC | AACTCTGTATTTTCTTTTGTAAGATTCATCGATCAATAAATCTTTAATCACATTCACAAA (SEQ ID NO: 44) | 4 |
| 45 mHC | CATAAATAAACACATGAAATATATGAAATCGAAATTAACCAGAAATCCGAGAACCTGAAA (SEQ ID NO: 46) | 4 |
| 46 sHC | CATAAATAAACACATGAAATATATGAAATCGAAATTAACCAGAAATCCGAGAACCTGAAA (SEQ ID NO: 46) | 4 |
| 47 mHC | CATAAATAAACACATGAAATATATGAAATCGAAAACTAAATCTCTAATCTCTAACCTTTC (SEQ ID NO: 48) | 4 |
| 48 sHC | CATAAATAAACACATGAAATATATGAAATCGAAAACTAAATCTCTAATCTCTAACCTTTC (SEQ ID NO: 48) | 4 |
| 49 sHC | TATCTAGATGTAGGTATATATTTATCTATCGATATCTCTGTTTTCTTTTGACTGGTGGTT (SEQ ID NO: 50) | 5 |
| 50 mHC | TATCTAGATGTAGGTATATATTTATCTATCGATATCTCTGTTTTCTTTTGACTGGTGGTT (SEQ ID NO: 50) | 5 |
| 51 mHC | CCACGGAGGGGTCCTTCTGAACTGCAATTCGAAGTGAAACTGCCTTTGATGGGCTCATCA (SEQ ID NO: 52) | 9 |

TABLE 1.a5-continued

| Loop | Detected | Probe sequence 60 mer | Probe Location Chr |
|---|---|---|---|
| 52 | sHC | CCACGGAGGGGTCCTTCTGAACTGCAATTCGAAGTGAAACTGCCTTTGATGGGCTCATCA (SEQ ID NO: 52) | 9 |

TABLE 1.a6

| | Probe Location | | | | 4 kb Sequence Location | | | |
|---|---|---|---|---|---|---|---|---|
| | Start1 | End1 | Start2 | End2 | Chr | Start1 | End1 | Start2 | End2 |
| 1 | 31011524 | 31011555 | 31024197 | 31024228 | 13 | 31007554 | 31011555 | 31020227 | 31024228 |
| 2 | 31011524 | 31011555 | 31024197 | 31024228 | 13 | 31007554 | 31011555 | 31020227 | 31024228 |
| 3 | 227782602 | 227782633 | 227877983 | 227878014 | 2 | 227778632 | 227782633 | 227874013 | 227878014 |
| 4 | 227782602 | 227782633 | 227877983 | 227878014 | 2 | 227778632 | 227782633 | 227874013 | 227878014 |
| 5 | 21022651 | 21022682 | 21093029 | 21093060 | 8 | 21022651 | 21026652 | 21093029 | 21097030 |
| 6 | 21022651 | 21022682 | 21093029 | 21093060 | 8 | 21022651 | 21026652 | 21093029 | 21097030 |
| 7 | 49148928 | 49148959 | 49219787 | 49219818 | 11 | 49144958 | 49148959 | 49215817 | 49219818 |
| 8 | 49148928 | 49148959 | 49219787 | 49219818 | 11 | 49144958 | 49148959 | 49215817 | 49219818 |
| 9 | 75290920 | 75290951 | 75323931 | 75323962 | 11 | 75290920 | 75294921 | 75323931 | 75327932 |
| 10 | 75290920 | 75290951 | 75323931 | 75323962 | 11 | 75290920 | 75294921 | 75323931 | 75327932 |
| 11 | 27276527 | 27276558 | 27309940 | 27309971 | 13 | 27276527 | 27280528 | 27309940 | 27313941 |
| 12 | 27276527 | 27276558 | 27309940 | 27309971 | 13 | 27276527 | 27280528 | 27309940 | 27313941 |
| 13 | 169021738 | 169021769 | 169105039 | 169105070 | 2 | 169017768 | 169021769 | 169101069 | 169105070 |
| 14 | 169021738 | 169021769 | 169105039 | 169105070 | 2 | 169017768 | 169021769 | 169101069 | 169105070 |
| 15 | 175809786 | 175809817 | 175829279 | 175829310 | 4 | 175805816 | 175809817 | 175829279 | 175833280 |
| 16 | 175809786 | 175809817 | 175829279 | 175829310 | 4 | 175805816 | 175809817 | 175829279 | 175833280 |
| 17 | 78549630 | 78549661 | 78567357 | 78567388 | 5 | 78549630 | 78553631 | 78563387 | 78567388 |
| 18 | 78549630 | 78549661 | 78567357 | 78567388 | 5 | 78549630 | 78553631 | 78563387 | 78567388 |
| 19 | 38686830 | 38686861 | 38749265 | 38749296 | 9 | 38682860 | 38686861 | 38745295 | 38749296 |
| 20 | 38686830 | 38686861 | 38749265 | 38749296 | 9 | 38682860 | 38686861 | 38745295 | 38749296 |
| 21 | 209631659 | 209631690 | 209662023 | 209662054 | 2 | 209627689 | 209631690 | 209658053 | 209662054 |
| 22 | 209631659 | 209631690 | 209662023 | 209662054 | 2 | 209627689 | 209631690 | 209658053 | 209662054 |
| 23 | 127085111 | 127085142 | 127117219 | 127117250 | 6 | 127085111 | 127089112 | 127117219 | 127121220 |
| 24 | 127085111 | 127085142 | 127117219 | 127117250 | 6 | 127085111 | 127089112 | 127117219 | 127121220 |
| 25 | 179885246 | 179885277 | 179956050 | 179956081 | 3 | 179881276 | 179885277 | 179956050 | 179960051 |
| 26 | 179885246 | 179885277 | 179956050 | 179956081 | 3 | 179881276 | 179885277 | 179956050 | 179960051 |
| 27 | 159103259 | 159103290 | 159125255 | 159125286 | 6 | 159103259 | 159107260 | 159121285 | 159125286 |
| 28 | 159103259 | 159103290 | 159125255 | 159125286 | 6 | 159103259 | 159107260 | 159121285 | 159125286 |
| 29 | 152738349 | 152738380 | 152809337 | 152809368 | 1 | 152738349 | 152742350 | 152805367 | 152809368 |
| 30 | 152738349 | 152738380 | 152809337 | 152809368 | 1 | 152738349 | 152742350 | 152805367 | 152809368 |
| 31 | 74050342 | 74050373 | 74077219 | 74077250 | 8 | 74050342 | 74054343 | 74077219 | 74081220 |
| 32 | 74050342 | 74050373 | 74077219 | 74077250 | 8 | 74050342 | 74054343 | 74077219 | 74081220 |
| 33 | 10063278 | 10063309 | 9948485 | 9948516 | 18 | 10063278 | 10067279 | 9944515 | 9948516 |
| 34 | 10063278 | 10063309 | 9948485 | 9948516 | 18 | 10063278 | 10067279 | 9944515 | 9948516 |
| 35 | 140794230 | 140794261 | 140900253 | 140900284 | 6 | 140794230 | 140798231 | 140896283 | 140900284 |
| 36 | 140794230 | 140794261 | 140900253 | 140900284 | 6 | 140794230 | 140798231 | 140896283 | 140900284 |
| 37 | 10067827 | 10067858 | 10158041 | 10158072 | 12 | 10063857 | 10067858 | 10154071 | 10158072 |
| 38 | 10067827 | 10067858 | 10158041 | 10158072 | 12 | 10063857 | 10067858 | 10154071 | 10158072 |
| 39 | 20304911 | 20304942 | 20328998 | 20329029 | 2 | 20300941 | 20304942 | 20328998 | 20332999 |
| 40 | 20304911 | 20304942 | 20328998 | 20329029 | 2 | 20300941 | 20304942 | 20328998 | 20332999 |
| 41 | 216702663 | 216702694 | 216719705 | 216719736 | 2 | 216698693 | 216702694 | 216719705 | 216723706 |
| 42 | 216702663 | 216702694 | 216719705 | 216719736 | 2 | 216698693 | 216702694 | 216719705 | 216723706 |
| 43 | 152218333 | 152218364 | 152270249 | 152270280 | 4 | 152214363 | 152218364 | 152266279 | 152270280 |
| 44 | 152218333 | 152218364 | 152270249 | 152270280 | 4 | 152214363 | 152218364 | 152266279 | 152270280 |
| 45 | 153731280 | 153731311 | 153764752 | 153764783 | 4 | 153727310 | 153731311 | 153760782 | 153764783 |
| 46 | 153731280 | 153731311 | 153764752 | 153764783 | 4 | 153727310 | 153731311 | 153760782 | 153764783 |
| 47 | 153731280 | 153731311 | 153769067 | 153769098 | 4 | 153727310 | 153731311 | 153765097 | 153769098 |
| 48 | 153731280 | 153731311 | 153769067 | 153769098 | 4 | 153727310 | 153731311 | 153765097 | 153769098 |
| 49 | 6226839 | 6226870 | 6298491 | 6298522 | 5 | 6222869 | 6226870 | 6298491 | 6302492 |
| 50 | 6226839 | 6226870 | 6298491 | 6298522 | 5 | 6222869 | 6226870 | 6298491 | 6302492 |
| 51 | 38686830 | 38686861 | 38760696 | 38760727 | 9 | 38682860 | 38686861 | 38756726 | 38760727 |
| 52 | 38686830 | 38686861 | 38760696 | 38760727 | 9 | 38682860 | 38686861 | 38756726 | 38760727 |

TABLE 1.a7

| | Probe | PCR-Primer1_ID | PCR_Primer1 |
|---|---|---|---|
| 1 | ORF1_13_31010097_31011555_31022136_31024228_FF | OBD159_001 | CTTCTGGAGTCACTTTCTCTTTTAGA (SEQ ID NO: 54) |

TABLE 1.a7-continued

| Probe | PCR-Primer1_ID | PCR_Primer1 |
|---|---|---|
| 2 ORF1_13_31010097_31011555_31022136_31024228_FF | OBD159_001 | CTTCTGGAGTCACTTTCTCTTTTAGA (SEQ ID NO: 54) |
| 3 ORF1_2_227779837_227782633_227875567_227878014_FF | OBD159_005 | CTGAAGTTGTAGCAGGCAGCATCCAT (SEQ ID NO: 56) |
| 4 ORF1_2_227779837_227782633_227875567_227878014_FF | OBD159_005 | CTGAAGTTGTAGCAGGCAGCATCCAT (SEQ ID NO: 56) |
| 5 ORF1_8_21022651_21025530_21093029_21096890_RR | OBD159_009 | GGTGAGGCTTCTGTTTTCGGGAGG (SEQ ID NO: 58) |
| 6 ORF1_8_21022651_21025530_21093029_21096890_RR | OBD159_009 | GGTGAGGCTTCTGTTTTCGGGAGG (SEQ ID NO: 58) |
| 7 ORF10_11_49143461_49148959_49212875_49219818_FF | OBD159_013 | GTTTCAGGACCACCCTCTACACC (SEQ ID NO: 60) |
| 8 ORF10_11_49143461_49148959_49212875_49219818_FF | OBD159_013 | GTTTCAGGACCACCCTCTACACC (SEQ ID NO: 60) |
| 9 ORF10_11_75290920_75295115_75323931_75326829_RR | OBD159_017 | CTGTTCTGGGTGCTTGGGATAGATGC (SEQ ID NO: 62) |
| 10 ORF10_11_75290920_75295115_75323931_75326829_RR | OBD159_017 | CTGTTCTGGGTGCTTGGGATAGATGC (SEQ ID NO: 62) |
| 11 ORF10_13_27276527_27282043_27309940_27312084_RR | OBD159_021 | GTGCCCTTCGCCTAAACACAAGC (SEQ ID NO: 64) |
| 12 ORF10_13_27276527_27282043_27309940_27312084_RR | OBD159_021 | GTGCCCTTCGCCTAAACACAAGC (SEQ ID NO: 64) |
| 13 ORF10_2_169020149_169021769_169092304_169105070_FF | OBD159_025 | CAACCTAACACAACATAGCCTGC (SEQ ID NO: 66) |
| 14 ORF10_2_169020149_169021769_169092304_169105070_FF | OBD159_025 | CAACCTAACACAACATAGCCTGC (SEQ ID NO: 66) |
| 15 ORF10_4_175807779_175809817_175829279_175833051_FR | OBD159_029 | TCTGACTGAACACATATGCT (SEQ ID NO: 68) |
| 16 ORF10_4_175807779_175809817_175829279_175833051_FR | OBD159_029 | TCTGACTGAACACATATGCT (SEQ ID NO: 68) |
| 17 ORF10_5_78549630_78552354_78564492_78567388_RF | OBD159_033 | GTGAAACCACCAGAGTAGTCAGGAAG (SEQ ID NO: 70) |
| 18 ORF10_5_78549630_78552354_78564492_78567388_RF | OBD159_033 | GTGAAACCACCAGAGTAGTCAGGAAG (SEQ ID NO: 70) |
| 19 ORF10_9_38681931_38686861_38745325_38749296_FF | OBD159_037 | GCCAGAAGTTCACAGGCAGGGTG (SEQ ID NO: 72) |
| 20 ORF10_9_38681931_38686861_38745325_38749296_FF | OBD159_037 | GCCAGAAGTTCACAGGCAGGGTG (SEQ ID NO: 72) |
| 21 ORF100_2_209628749_209631690_209659511_209662054_FF | OBD159_041 | CCCTCAGGCTTCTGTTGTTGGCA (SEQ ID NO: 74) |
| 22 ORF100_2_209628749_209631690_209659511_209662054_FF | OBD159_041 | CCCTCAGGCTTCTGTTGTTGGCA (SEQ ID NO: 74) |
| 23 ORF101_6_127085111_127088243_127117219_127121367_RR | OBD159_045 | GTTGCTGCCAGAGACCCATCCCA (SEQ ID NO: 76) |
| 24 ORF101_6_127085111_127088243_127117219_127121367_RR | OBD159_045 | GTTGCTGCCAGAGACCCATCCCA (SEQ ID NO: 76) |
| 25 ORF102_3_179882870_179885277_179956050_179960326_FR | OBD159_049 | GGAGAGTATTATGGATTGAGTGGTCT (SEQ ID NO: 78) |
| 26 ORF102_3_179882870_179885277_179956050_179960326_FR | OBD159_049 | GGAGAGTATTATGGATTGAGTGGTCT (SEQ ID NO: 78) |
| 27 ORF104_6_159103259_159105928_159122150_159125286_RR | OBD159_053 | CCACTTGCCCTGTGCTCGCCAGC (SEQ ID NO: 80) |

TABLE 1.a7-continued

| Probe | PCR-Primer1_ID | PCR_Primer1 |
|---|---|---|
| 28 ORF104_6_159103259_159105928_159122150_159125286_RR | OBD159_053 | CCACTTGCCCTGTGCTCGCCAGC (SEQ ID NO: 80) |
| 29 ORF106_1_152738349_152759424_152785124_152809368_RR | OBD159_057 | GACATTTGGTGACCCATTACTCAACA (SEQ ID NO: 82) |
| 30 ORF106_1_152738349_152759424_152785124_152809368_RR | OBD159_057 | GACATTTGGTGACCCATTACTCAACA (SEQ ID NO: 82) |
| 31 ORF106_8_74050342_74056528_74077219_74079715_RR | OBD159_061 | GGCGGGTGGGTATGTGTTATGGG (SEQ ID NO: 84) |
| 32 ORF106_8_74050342_74056528_74077219_74079715_RR | OBD159_061 | GGCGGGTGGGTATGTGTTATGGG (SEQ ID NO: 84) |
| 33 ORF107_18_10063278_10067780_9946347_9948516_RF | OBD159_065 | TTTGGCAAGGCATAGAATAGAATA (SEQ ID NO: 86) |
| 34 ORF107_18_10063278_10067780_9946347_9948516_RF | OBD159_065 | TTTGGCAAGGCATAGAATAGAATA (SEQ ID NO: 86) |
| 35 ORF107_6_140794230_140798634_140883673_140900284_RR | OBD159_069 | GTGTCACAATAAAATGGCATAAAA (SEQ ID NO: 88) |
| 36 ORF107_6_140794230_140798634_140883673_140900284_RR | OBD159_069 | GTGTCACAATAAAATGGCATAAAA (SEQ ID NO: 88) |
| 37 ORF11_12_10066384_10067858_10157054_10158072_FF | OBD159_073 | TCTCTTTCATTGAGTTCTAAGTTA (SEQ ID NO: 90) |
| 38 ORF11_12_10066384_10067858_10157054_10158072_FF | OBD159_073 | TCTCTTTCATTGAGTTCTAAGTTA (SEQ ID NO: 90) |
| 39 ORF11_2_20303337_20304942_20328998_20331608_FR | OBD159_077 | CATTTGTCAACTCACACTCTAAAA (SEQ ID NO: 92) |
| 40 ORF11_2_20303337_20304942_20328998_20331608_FR | OBD159_077 | CATTTGTCAACTCACACTCTAAAA (SEQ ID NO: 92) |
| 41 ORF11_2_216695404_216702694_216719705_216724855_FR | OBD159_081 | GGTGTTACTTGGCTTCTATGCCTTAG (SEQ ID NO: 94) |
| 42 ORF11_2_216695404_216702694_216719705_216724855_FR | OBD159_081 | GGTGTTACTTGGCTTCTATGCCTTAG (SEQ ID NO: 94) |
| 43 ORF11_4_152216416_152218364_152265231_152270280_FF | OBD159_085 | TGAAATGAGCAGGTGGGAGTAGGTG G (SEQ ID NO: 96) |
| 44 ORF11_4_152216416_152218364_152265231_152270280_FF | OBD159_085 | TGAAATGAGCAGGTGGGAGTAGGTG G (SEQ ID NO: 96) |
| 45 ORF11_4_153729106_153731311_153760093_153764783_FF | OBD159_089 | TATGAAATGTAGGAATGCTGTCCCTC (SEQ ID NO: 98) |
| 46 ORF11_4_153729106_153731311_153760093_153764783_FF | OBD159_089 | TATGAAATGTAGGAATGCTGTCCCTC (SEQ ID NO: 98) |
| 47 ORF11_4_153729106_153731311_153764783_153769098_FF | OBD159_093 | TATGAAATGTAGGAATGCTGTCCCTC (SEQ ID NO: 98) |
| 48 ORF11_4_153729106_153731311_153764783_153769098_FF | OBD159_093 | TATGAAATGTAGGAATGCTGTCCCTC (SEQ ID NO: 98) |
| 49 ORF11_5_6223946_6226870_6298491_6302848_FR | OBD159_097 | CTGTTCTCAGCAATGGAATCTCAGGT (SEQ ID NO: 102) |
| 50 ORF11_5_6223946_6226870_6298491_6302848_FR | OBD159_097 | CTGTTCTCAGCAATGGAATCTCAGGT (SEQ ID NO: 102) |
| 51 ORF11_9_38681931_38686861_38758125_38760727_FF | OBD159_101 | CAGAAGTTCACAGGCAGGGTGTCTTG (SEQ ID NO: 104) |
| 52 ORF11_9_38681931_38686861_38758125_38760727_FF | OBD159_101 | CAGAAGTTCACAGGCAGGGTGTCTTG (SEQ ID NO: 104) |

TABLE 1.a8

| | PCR-Primer2_ID | PCR_Primer2 | Gene | Marker | GLMNET |
|---|---|---|---|---|---|
| 1 | OBD159_003 | AGCCTGGGCGACAGAGTGAGACT (SEQ ID NO: 106) | HSPH1; TEX26 | OBD159_001_003 | -0.00243741 |
| 2 | OBD159_003 | AGCCTGGGCGACAGAGTGAGACT (SEQ ID NO: 106) | HSPH1; TEX26 | OBD159_001_003 | -0.00243741 |
| 3 | OBD159_007 | GAGGTTTTGTCACAGCGAAGCAGTCA (SEQ ID NO: 108) | CCL20; DAW1; rs113776284; rs7556897; rs4973341; rs1811711; rs13384448; rs7591163 | OBD159_005_007 | -0.002876667 |
| 4 | OBD159_007 | GAGGTTTTGTCACAGCGAAGCAGTCA (SEQ ID NO: 108) | CCL20; DAW1; rs113776284; rs7556897; rs4973341; rs1811711; rs13384448; rs7591163 | OBD159_005_007 | -0.002876667 |
| 5 | OBD159_011 | AGGATTTGGGTCCCTGGTCTCCA (SEQ ID NO: 110) | rs7015657; rs500816 | OBD159_009_011 | -0.002158394 |
| 6 | OBD159_011 | AGGATTTGGGTCCCTGGTCTCCA (SEQ ID NO: 110) | rs7015657; rs500816 | OBD159_009_011 | -0.002158394 |
| 7 | OBD159_015 | CCAGTTCTTCCCTTCCAGAGCAGG (SEQ ID NO: 112) | FOLH1; TRIM64C; rs368939818; rs61886492; rs770894245; rs747052707; rs202680; rs202676 | OBD159_013_015 | -0.000632005 |
| 8 | OBD159_015 | CCAGTTCTTCCCTTCCAGAGCAGG (SEQ ID NO: 112) | FOLH1; TRIM64C; rs368939818; rs61886492; rs770894245; rs747052707; rs202680; rs202676 | OBD159_013_015 | -0.000632005 |
| 9 | OBD159_019 | TTTGTGCTTCTTGCTGTGTGTGTGTG (SEQ ID NO: 114) | ARRB1; rs7952044; rs737410 | OBD159_017_019 | -0.004167216 |
| 10 | OBD159_019 | TTTGTGCTTCTTGCTGTGTGTGTGTG (SEQ ID NO: 114) | ARRB1; rs7952044; rs737410 | OBD159_017_019 | -0.004167216 |
| 11 | OBD159_023 | GAGACTCTGACCCGTCCCCTGAT (SEQ ID NO: 116) | RASL11A; rs9512637 | OBD159_021_023 | -0.003093498 |
| 12 | OBD159_023 | GAGACTCTGACCCGTCCCCTGAT (SEQ ID NO: 116) | RASL11A; rs9512637 | OBD159_021_023 | -0.003093498 |
| 13 | OBD159_027 | CAAGTGACTCCATTTTGGTTGTGACA (SEQ ID NO: 118) | ABCB11; DHRS9; rs886043986; rs2161037 | OBD159_025_027 | -0.002380456 |
| 14 | OBD159_027 | CAAGTGACTCCATTTTGGTTGTGACA (SEQ ID NO: 118) | ABCB11; DHRS9; rs886043986; rs2161037 | OBD159_025_027 | -0.002380456 |
| 15 | OBD159_031 | AATACCAACAATAATTTGT (SEQ ID NO: 120) | GPM6A; rs13144140 | OBD159_029_031 | -0.000660848 |
| 16 | OBD159_031 | AATACCAACAATAATTTGT (SEQ ID NO: 120) | GPM6A; rs13144140 | OBD159_029_031 | -0.000660848 |
| 17 | OBD159_035 | GAAAGTGGTCTTCCTCCGCCTCTAT (SEQ ID NO: 122) | LHFPL2; rs72315235; rs344650 | OBD159_033_035 | -0.000406493 |
| 18 | OBD159_035 | GAAAGTGGTCTTCCTCCGCCTCTAT (SEQ ID NO: 122) | LHFPL2; rs72315235; rs344650 | OBD159_033_035 | -0.000406493 |
| 19 | OBD159_039 | GCCCAACTCTGCCTGCTGAAATC (SEQ ID NO: 124) | ANKRD18A; CNTNAP3 | OBD159_037_039 | -0.002198949 |
| 20 | OBD159_039 | GCCCAACTCTGCCTGCTGAAATC (SEQ ID NO: 124) | ANKRD18A; CNTNAP3 | OBD159_037_039 | -0.002198949 |
| 21 | OBD159_043 | GCAGGTATTGCCAGCCACAGCGT (SEQ ID NO: 126) | MAP2; rs146432517; rs9288410 | OBD159_041_043 | -0.003078755 |
| 22 | OBD159_043 | GCAGGTATTGCCAGCCACAGCGT (SEQ ID NO: 126) | MAP2; rs146432517; rs9288410 | OBD159_041_043 | -0.003078755 |
| 23 | OBD159_047 | CGGTAGCACCAGCCGATGAACTT (SEQ ID NO: 128) | RSPO3; rs1936807; rs4580892; rs719726; rs2745349; rs1936792; | OBD159_045_047 | -0.002660313 |

TABLE 1.a8-continued

| | PCR-Primer2_ID | PCR_Primer2 | Gene | Marker | GLMNET |
|---|---|---|---|---|---|
| | | | rs1936797; rs1936799; rs1936800; rs1555091 | | |
| 24 | OBD159_047 | CGGTAGCACCAGCCGATGAACTT (SEQ ID NO: 128) | RSPO3; rs1936807; rs4580892; rs719726; rs2745349; rs1936792; rs1936797; rs1936799; rs1936800; rs1555091 | OBD159_045_047 | -0.002660313 |
| 25 | OBD159_051 | CTCTAAGCCTTGACTTCCCTATCAGC (SEQ ID NO: 130) | PEX5L; rs146906651 | OBD159_049_051 | 0.000980386 |
| 26 | OBD159_051 | CTCTAAGCCTTGACTTCCCTATCAGC (SEQ ID NO: 130) | PEX5L; rs146906651 | OBD159_049_051 | 0.000980386 |
| 27 | OBD159_055 | GAGAAAATCTTGAATGGGAATCCAGT (SEQ ID NO: 132) | rs2249937; rs9355260 | OBD159_053_055 | -0.004017137 |
| 28 | OBD159_055 | GAGAAAATCTTGAATGGGAATCCAGT (SEQ ID NO: 132) | rs2249937; rs9355260 | OBD159_053_055 | -0.004017137 |
| 29 | OBD159_059 | GGAGGCATTTGGCTTGTCCCCAGATT (SEQ ID NO: 134) | KPRP; LCE1B; LCE1C; LCE1D; LCE1E; LCE1F; rs7517755; rs 77199844; rs6701216 | OBD159_057_059 | -0.001306703 |
| 30 | OBD159_059 | GGAGGCATTTGGCTTGTCCCCAGATT (SEQ ID NO: 134) | KPRP; LCE1B; LCE1C; LCE1D; LCE1E; LCE1F; rs7517755; rs77199844; rs6701216 | OBD159_057_059 | -0.001306703 |
| 31 | OBD159_063 | GGTCTTCATTCCTGGTTCCTGGC (SEQ ID NO: 136) | LY96; rs6472827 | OBD159_061_063 | -0.003175406 |
| 32 | OBD159_063 | GGTCTTCATTCCTGGTTCCTGGC (SEQ ID NO: 136) | LY96; rs6472827 | OBD159_061_063 | -0.003175406 |
| 33 | OBD159_067 | TTTGGCAAGGCATAGAATAGAATA (SEQ ID NO: 86) | VAPA; rs8089099; rs29067; rs29066 | OBD159_065_067 | -0.001345057 |
| 34 | OBD159_067 | TTTGGCAAGGCATAGAATAGAATA (SEQ ID NO: 86) | VAPA; rs8089099; rs29067; rs29066 | OBD159_065_067 | -0.001345057 |
| 35 | OBD159_071 | CATCCCATTCTCAGCATTTGATTA (SEQ ID NO: 140) | rs146383502; rs11155133 | OBD159_069_071 | -0.003773782 |
| 36 | OBD159_071 | CATCCCATTCTCAGCATTTGATTA (SEQ ID NO: 140) | rs11155133 | OBD159_069_071 | -0.003773782 |
| 37 | OBD159_075 | TGAGATTGTGCCACTGAACTCCAG (SEQ ID NO: 142) | CLEC1A; CLEC7A; OLR1; rs16910526; rs16910527; rs7309123; rs2078178; rs3901533 | OBD159_073_075 | -0.002317351 |
| 38 | OBD159_075 | TGAGATTGTGCCACTGAACTCCAG (SEQ ID NO: 142) | CLEC1A; CLEC7A; OLR1; rs16910526; rs16910527; rs7309123; rs2078178; rs3901533 | OBD159_073_075 | -0.002317351 |
| 39 | OBD159_079 | TGGTTTACTGCTGTAGCCTTGACCT (SEQ ID NO: 144) | PUM2; rs111612372 | OBD159_077_079 | -0.003104042 |
| 40 | OBD159_079 | TGGTTTACTGCTGTAGCCTTGACCT (SEQ ID NO: 144) | PUM2; rs111612372 | OBD159_077_079 | -0.003104042 |
| 41 | OBD159_083 | GCTGCTTAGGGACACCGAAAAGGTTC (SEQ ID NO: 146) | IGFBP2; IGFBP5 | OBD159_081_083 | -0.000193892 |
| 42 | OBD159_083 | GCTGCTTAGGGACACCGAAAAGGTTC (SEQ ID NO: 146) | IGFBP2; IGFBP5 | OBD159_081_083 | -0.000193892 |
| 43 | OBD159_087 | CGGAAAATGAGGAAGAGAGGAGGA TA (SEQ ID NO: 148) | FBXW7; rs522743 | OBD159_085_087 | -0.003996906 |
| 44 | OBD159_087 | CGGAAAATGAGGAAGAGAGGAGGA TA (SEQ ID NO: 148) | FBXW7; rs522743 | OBD159_085_087 | -0.003996906 |
| 45 | OBD159_091 | GGTTCGTGTAACAGCCAGTTCATTTA (SEQ ID NO: 150) | RNF175; SFRP2 | OBD159_089_091 | -0.000814697 |

TABLE 1.a8-continued

| PCR-Primer2_ID | PCR_Primer2 | Gene | Marker | GLMNET |
|---|---|---|---|---|
| 46 OBD159_091 | GGTTCGTGTAACAGCCAGTTCATTTA (SEQ ID NO: 150) | RNF175; SFRP2 | OBD159_089_091 | -0.000814697 |
| 47 OBD159_095 | CCAGGCTACACAGACATAGTTGT (SEQ ID NO: 152) | RNF175; SFRP2 | OBD159_093_095 | -0.000471857 |
| 48 OBD159_095 | CCAGGCTACACAGACATAGTTGT (SEQ ID NO: 152) | RNF175; SFRP2 | OBD159_093_095 | -0.000471857 |
| 49 OBD159_099 | CAATAACTGAATGGCTGAGTCTGAAA (SEQ ID NO: 154) | rs12518614 | OBD159_097_099 | -0.004138741 |
| 50 OBD159_099 | CAATAACTGAATGGCTGAGTCTGAAA (SEQ ID NO: 154) | rs12518614 | OBD159_097_099 | -0.004138741 |
| 51 OBD159_103 | CATTTGGAATCTTCTCACGGTTGCTG (SEQ ID NO: 156) | ANKRD18A; CNTNAP3 | OBD159_101_103 | -0.002219289 |
| 52 OBD159_103 | CATTTGGAATCTTCTCACGGTTGCTG (SEQ ID NO: 156) | ANKRD18A; CNTNAP3 | OBD159_101_103 | -0.002219289 |

TABLE 1.b1

| Probe | GeneLocus |
|---|---|
| 53 ORF11_9_38681931_38686861_38760727_38762491_FF | ANKRD18A; CNTNAP3 |
| 54 ORF11_9_38681931_38686861_38760727_38762491_FF | ANKRD18A; CNTNAP3 |
| 55 ORF11_X_38261316_38264212_38327821_38333719_FR | RP5-972B16.2; RPGR; rs5963409; rs771214648; rs606231180; rs606231181; rs137852551; rs267607019; rs730882261; rs398122960; rs527236108; rs869312185; rs1060501181; rs62635004; rs771039023; rs527236109; rs62640593; rs527236112; rs62640590; rs62640589; rs527236111; rs62640587; rs62642057; rs878853374; rs138018739; rs62650220; rs62638651; rs62650218; rs137852550; rs62638646; rs62638644; rs62638643; rs62638637; rs62638636; rs111631988; rs62638634; rs62638630; rs62638629 |
| 56 ORF11_X_38261316_38264212_38327821_38333719_FR | RP5-972B16.2; RPGR; rs5963409; rs771214648; rs606231180; rs606231181; rs137852551; rs267607019; rs730882261; rs398122960; rs527236108; rs869312185; rs1060501181; rs62635004; rs771039023; rs527236109; rs62640593; rs527236112; rs62640590; rs62640589; rs527236111; rs62640587; rs62642057; rs878853374; rs138018739; rs62650220; rs62638651; rs62650218; rs137852550; rs62638646; rs62638644; rs62638643; rs62638637; rs62638636; rs111631988; rs62638634; rs62638630; rs62638629 |
| 57 ORF110_2_21300802_21304831_21382106_21387178_FF | rs59014890; rs2337901 |
| 58 ORF110_2_21300802_21304831_21382106_21387178_FF | rs59014890; rs2337901 |
| 59 ORF111_9_28333777_28339631_28367003_28368817_FR | LINGO2; rs7851437 |
| 60 ORF111_9_28333777_28339631_28367003_28368817_FR | LINGO2; rs7851437 |
| 61 ORF112_2_21325579_21332004_21387178_21390560_FR | rs2337901; rs11897825 |
| 62 ORF112_2_21325579_21332004_21387178_21390560_FR | rs2337901; rs11897825 |
| 63 ORF112_3_127239888_127246012_127301511_127306201_RR | C3orf56; rs7610266 |
| 64 ORF112_3_127239888_127246012_127301511_127306201_RR | C3orf56; rs7610266 |
| 65 ORF113_2_21325579_21332004_21387178_21390560_FF | rs2337901; rs11897825 |
| 66 ORF113_2_21325579_21332004_21387178_21390560_FF | rs2337901; rs11897825 |
| 67 ORF115_9_105415801_105419712_105449848_105451637_RF | FKTN; FSD1L; SLC44A1 |
| 68 ORF115_9_105415801_105419712_105449848_105451637_RF | FKTN; FSD1L; SLC44A1 |
| 69 ORF116_3_37914711_37917540_37993419_37999345_FR | CTDSPL; PLCD1; VILL; rs7372209 |
| 70 ORF116_3_37914711_37917540_37993419_37999345_FR | CTDSPL; PLCD1; VILL; rs7372209 |
| 71 ORF117_13_87499323_87503053_87526042_87529747_FF | SLITRK5 |
| 72 ORF117_13_87499323_87503053_87526042_87529747_FF | SLITRK5 |
| 73 ORF117_2_209621630_209626755_209659511_209662054_FF | MAP2; rs146432517; rs9288410 |
| 74 ORF117_2_209621630_209626755_209659511_209662054_FF | MAP2; rs146432517; rs9288410 |
| 75 ORF119_1_213896516_213907154_213954211_213958027_RF | rs7529073; rs4342822 |
| 76 ORF119_1_213896516_213907154_213954211_213958027_RF | rs7529073; rs4342822 |

TABLE 1.b1-continued

| Probe | GeneLocus |
|---|---|
| 77 ORF119_8_13602479_13607345_13658646_13661358_RR | C8orf48 |
| 78 ORF119_8_13602479_13607345_13658646_13661358_RR | C8orf48 |
| 79 ORF12_1_13873315_13874983_13945271_13952984_RF | rs7542939 |
| 80 ORF12_1_13873315_13874983_13945271_13952984_RF | rs7542939 |
| 81 ORF12_1_240091688_240094684_240158711_240162261_FR | FMN2; rs727502861; rs727502860 |
| 82 ORF12_1_240091688_240094684_240158711_240162261_FR | FMN2; rs727502861; rs727502860 |
| 83 ORF12_1_36409666_36411937_36433268_36434547_RR | LSM10; OSCP1 |
| 84 ORF12_1_36409666_36411937_36433268_36434547_RR | LSM10; OSCP1 |
| 85 ORF12_12_75070822_75072825_75136236_75139196_RR | CAPS2; KCNC2 |
| 86 ORF12_12_75070822_75072825_75136236_75139196_RR | CAPS2; KCNC2 |
| 87 ORF12_14_50687093_50690663_50737547_50743189_FR | NIN; rs387907308; rs146291102 |
| 88 ORF12_14_50687093_50690663_50737547_50743189_FR | NIN; rs387907308; rs146291102 |
| 89 ORF12_2_11479893_11482767_11532162_11535545_RR | NIN; rs387907308; rs146291102 |
| 90 ORF12_2_11479893_11482767_11532162_11535545_RR | E2F6; GREB1; rs77294520 |
| 91 ORF12_4_37796365_37802481_37862832_37864637_RR | GAFA3; PGM2 |
| 92 ORF12_4_37796365_37802481_37862832_37864637_RR | GAFA3; PGM2 |
| 93 ORF12_9_38681931_38686861_38738766_38743008_FF | ANKRD18A; CNTNAP3 |
| 94 ORF12_9_38681931_38686861_38738766_38743008_FF | ANKRD18A; CNTNAP3 |
| 95 ORF12_X_115884702_115886518_115936015_115945579_RF | PLS3; rs201386833 |
| 96 ORF12_X_115884702_115886518_115936015_115945579_RF | PLS3; rs201386833 |
| 97 ORF12_X_38261316_38264212_38327821_38333719_FF | RP5-972B16.2; RPGR; rs5963409; rs771214648; rs606231180; rs606231181; rs137852551; rs267607019; rs730882261; rs398122960; rs527236108; rs869312185; rs1060501181; rs62635004; rs771039023; rs527236109; rs62640593; rs527236112; rs62640590; rs62640589; rs527236111; rs62640587; rs62642057; rs878853374; rs138018739; rs62650220; rs62638651; rs62650218; rs137852550; rs62638646; rs62638644; rs62638643; rs62638637; rs62638636; rs111631988; rs62638634; rs62638630; rs62638629 |
| 98 ORF12_X_38261316_38264212_38327821_38333719_FF | RP5-972B16.2; RPGR; rs5963409; rs771214648; rs606231180; rs606231181; rs137852551; rs267607019; rs730882261; rs398122960; rs527236108; rs869312185; rs1060501181; rs62635004; rs771039023; rs527236109; rs62640593; rs527236112; rs62640590; rs62640589; rs527236111; rs62640587; rs62642057; rs878853374; rs138018739; rs62650220; rs62638651; rs62650218; rs137852550; rs62638646; rs62638644; rs62638643; rs62638637; rs62638636; rs111631988; rs62638634; rs62638630; rs62638629 |
| 99 ORF123_6_84727932_84732502_84775145_84786636_FF | TBX18; rs72912698; rs760905589; rs869320679; rs797045022; rs77693245 |
| 100 ORF123_6_84727932_84732502_84775145_84786636_FF | TBX18; rs72912698; rs760905589; rs869320679; rs797045022; rs77693245 |
| 101 ORF125_21_15444025_15470065_15500094_15503881_RF | rs1736020; rs1297265; rs2823286; rs2823288; rs2823310 |
| 102 ORF125_21_15444025_15470065_15500094_15503881_RF | rs1736020; rs1297265; rs2823286; rs2823288; rs2823310 |
| 103 ORF127_5_127434266_127436041_127487600_127490915_RF | MEGF10; rs794726677; rs387907071; rs387907072; rs199750143; rs794726678; rs989552169 |
| 104 ORF127_5_127434266_127436041_127487600_127490915_RF | MEGF10; rs794726677; rs387907071; rs387907072; rs199750143; rs794726678; rs989552169 |
| 105 ORF13_1_207936305_207938059_207957832_207960627_RR | rs2745959; rs2745967; rs11578508 |
| 106 ORF13_1_207936305_207938059_207957832_207960627_RR | rs2745959; rs2745967; rs11578508 |
| 107 ORF13_11_49143461_49148959_49200052_49204610_FR | FOLH1; rs202676; rs368939818; rs61886492; rs770894245; rs747052707; rs202680 |
| 108 ORF13_11_49143461_49148959_49200052_49204610_FR | FOLH1; rs202676; rs368939818; rs61886492; rs770894245; rs747052707; rs202680 |
| 109 ORF13_12_83941063_83942894_83954032_83957600_FF | rs11116045; rs1545843 |
| 110 ORF13_12_83941063_83942894_83954032_83957600_FF | rs11116045; rs1545843 |
| 111 ORF13_13_98188349_98189635_98215516_98217335_FR | FARP1; RNF113B |
| 112 ORF13_13_98188349_98189635_98215516_98217335_FR | FARP1; RNF113B |

TABLE 1.b2

| | Probe_Count_Total | Probe_Count_Sig | HyperG_Stats |
|---|---|---|---|
| 53 | 21; 8 | 8; 8; 8; 8 | 6.3e−07; 1.12e−06; 5.16e−12; 9.55e−12 |
| 54 | 21; 8 | 8; 8; 8; 8 | 6.3e−07; 1.12e−06; 5.16e−12; 9.55e−12 |
| 55 | 37; 34 | 2; 2; 2; 2 | 0.251937703; 0.262259643; 0.239085742; 0.251319324 |
| 56 | 37; 34 | 2; 2; 2; 2 | 0.251937703; 0.262259643; 0.239085742; 0.251319324 |
| 57 | NA | NA | NA |
| 58 | NA | NA | NA |
| 59 | 20 | 6; 4 | 7.69e−05; 0.007618647 |
| 60 | 20 | 6; 4 | 7.69e−05; 0.007618647 |
| 61 | NA | NA | NA |
| 62 | NA | NA | NA |
| 63 | 31 | 1; 1 | 0.366789724; 0.359323344 |
| 64 | 31 | 1; 1 | 0.366789724; 0.359323344 |
| 65 | NA | NA | NA |
| 66 | NA | NA | NA |
| 67 | 4; 18; 18 | 1; 1; 2; 2; 2; 2 | 0.138432982; 0.14804367; 0.123103064; 0.136301816; 0.123103064; 0.136301816 |
| 68 | 4; 18; 18 | 1; 1; 2; 2; 2; 2 | 0.138432982; 0.14804367; 0.123103064; 0.136301816; 0.123103064; 0.136301816 |
| 69 | 47; 8; 34 | 1; 1; 1; 1; 1; 1 | 0.29419612; 0.273584951; 0.236185646; 0.249326315; 0.357029649; 0.346365974 |
| 70 | 47; 8; 34 | 1; 1; 1; 1; 1; 1 | 0.29419612; 0.273584951; 0.236185646; 0.249326315; 0.357029649; 0.346365974 |
| 71 | 6 | 1; 1 | 0.191789359; 0.203777963 |
| 72 | 6 | 1; 1 | 0.191789359; 0.203777963 |
| 73 | 60 | 5; 7 | 0.05512946; 0.009185497 |
| 74 | 60 | 5; 7 | 0.05512946; 0.009185497 |
| 75 | NA | NA | NA |
| 76 | NA | NA | NA |
| 77 | 8 | 2; 1 | 0.033505489; 0.249326315 |
| 78 | 8 | 2; 1 | 0.033505489; 0.249326315 |
| 79 | NA | NA | NA |
| 80 | NA | NA | NA |
| 81 | 52 | 1; 1 | 0.266738689; 0.244043749 |
| 82 | 52 | 1; 1 | 0.266738689; 0.244043749 |
| 83 | 124; 112 | 3; 3; 3; 3 | 0.149414204; 0.126913559; 0.17713842; 0.156487188 |
| 84 | 124; 112 | 3; 3; 3; 3 | 0.149414204; 0.126913559; 0.17713842; 0.156487188 |
| 85 | 13; 13 | 4; 4; 4; 4 | 0.001148684; 0.001517434; 0.001148684; 0.001517434 |
| 86 | 13; 13 | 4; 4; 4; 4 | 0.001148684; 0.001517434; 0.001148684; 0.001517434 |
| 87 | 19 | 1; 1 | 0.362286681; 0.369026848 |
| 88 | 19 | 1; 1 | 0.362286681; 0.369026848 |
| 89 | 48; 40 | 4; 1; 4; 1 | 0.078104352; 0.267628012; 0.050377953; 0.314741981 |
| 90 | 48; 40 | 4; 1; 4; 1 | 0.078104352; 0.267628012; 0.050377953; 0.314741981 |
| 91 | 37; 37 | 5; 8; 5; 8 | 0.010942367; 0.000107113; 0.010942367; 0.000107113 |
| 92 | 37; 37 | 5; 8; 5; 8 | 0.010942367; 0.000107113; 0.010942367; 0.000107113 |
| 93 | 21; 8 | 8; 8; 8; 8 | 6.3e−07; 1.12e−06; 5.16e−12; 9.55e−12 |
| 94 | 21; 8 | 8; 8; 8; 8 | 6.3e−07; 1.12e−06; 5.16e−12; 9.55e−12 |
| 95 | 29 | 2; 5 | 0.211050406; 0.005560973 |
| 96 | 29 | 2; 5 | 0.211050406; 0.005560973 |
| 97 | 37; 34 | 2; 2; 2; 2 | 0.251937703; 0.262259643; 0.239085742; 0.251319324 |
| 98 | 37; 34 | 2; 2; 2; 2 | 0.251937703; 0.262259643; 0.239085742; 0.251319324 |
| 99 | 20 | 4; 5 | 0.005899409; 0.001067155 |
| 100 | 20 | 4; 5 | 0.005899409; 0.001067155 |
| 101 | NA | NA | NA |
| 102 | NA | NA | NA |
| 103 | 26 | 3; 3 | 0.061689421; 0.072111 |
| 104 | 26 | 3; 3 | 0.061689421; 0.072111 |
| 105 | NA | NA | NA |
| 106 | NA | NA | NA |
| 107 | 25 | 3; 4 | 0.05677955; 0.016055763 |
| 108 | 25 | 3; 4 | 0.05677955; 0.016055763 |
| 109 | NA | NA | NA |
| 110 | NA | NA | NA |
| 111 | 22; 19 | 1; 1; 1; 1 | 0.372324987; 0.375573766; 0.362286681; 0.369026848 |
| 112 | 22; 19 | 1; 1; 1; 1 | 0.372324987; 0.375573766; 0.362286681; 0.369026848 |

TABLE 1.b3

| | FDR_HyperG | Percent_Sig | logFC | AveExpr |
|---|---|---|---|---|
| 53 | 0.000109745; 0.00028483; 1.35e−09; 4.87e−09 | 38.1; 38.1; 100; 100 | 0.821558647 | 0.821558647 |
| 54 | 0.000109745; 0.00028483; 1.35e−09; 4.87e−09 | 38.1; 38.1; 100; 100 | 0.657823469 | 0.657823469 |
| 55 | 0.375519541; 0.376115439; 0.375519541; 0.376115439 | 5.41; 5.41; 5.88; 5.88 | 0.605549866 | 0.605549866 |
| 56 | 0.375519541; 0.376115439; 0.375519541; 0.376115439 | 5.41; 5.41; 5.88; 5.88 | 0.509980504 | 0.509980504 |

TABLE 1.b3-continued

| | FDR_HyperG | Percent_Sig | logFC | AveExpr |
|---|---|---|---|---|
| 57 | NA | NA | 0.829723114 | 0.829723114 |
| 58 | NA | NA | 0.704138453 | 0.704138453 |
| 59 | 0.008046243; 0.242844385 | 30; 20 | 0.572598955 | 0.572598955 |
| 60 | 0.008046243; 0.242844385 | 30; 20 | 0.527267248 | 0.527267248 |
| 61 | NA | NA | 0.79819641 | 0.79819641 |
| 62 | NA | NA | 0.714249608 | 0.714249608 |
| 63 | 0.375519541; 0.376115439 | 3.23; 3.23 | 0.549593463 | 0.549593463 |
| 64 | 0.375519541; 0.376115439 | 3.23; 3.23 | 0.519184321 | 0.519184321 |
| 65 | NA | NA | 0.76945482 | 0.76945482 |
| 66 | NA | NA | 0.637422788 | 0.637422788 |
| 67 | 0.375519541; 0.376115439; 0.375519541; 0.376115439; 0.375519541; 0.376115439 | 25; 25; 11.11; 11.11; 11.11; 11.11 | 0.633540142 | 0.633540142 |
| 68 | 0.375519541; 0.376115439; 0.375519541; 0.376115439; 0.375519541; 0.376115439 | 25; 25; 11.11; 11.11; 11.11; 11.11 | 0.567144081 | 0.567144081 |
| 69 | 0.375519541; 0.376115439; 0.375519541; 0.376115439; 0.375519541; 0.376115439 | 2.13; 2.13; 12.5; 12.5; 2.94; 2.94 | 0.734451615 | 0.734451615 |
| 70 | 0.375519541; 0.376115439; 0.375519541; 0.376115439; 0.375519541; 0.376115439 | 2.13; 2.13; 12.5; 12.5; 2.94; 2.94 | 0.541384922 | 0.541384922 |
| 71 | 0.375519541; 0.376115439 | 16.67; 16.67 | 0.565217156 | 0.565217156 |
| 72 | 0.375519541; 0.376115439 | 16.67; 16.67 | 0.553862818 | 0.553862818 |
| 73 | 0.375519541; 0.275564898 | 8.33; 11.67 | 0.778409164 | 0.778409164 |
| 74 | 0.375519541; 0.275564898 | 8.33; 11.67 | 0.551177343 | 0.551177343 |
| 75 | NA | NA | 0.669924722 | 0.669924722 |
| 76 | NA | NA | 0.611561332 | 0.611561332 |
| 77 | 0.375519541; 0.376115439 | 25; 12.5 | 0.752596399 | 0.752596399 |
| 78 | 0.375519541; 0.376115439 | 25; 12.5 | 0.707611524 | 0.707611524 |
| 79 | NA | NA | 0.667711917 | 0.667711917 |
| 80 | NA | NA | 0.583354186 | 0.583354186 |
| 81 | 0.375519541; 0.376115439 | 1.92; 1.92 | 0.54528191 | 0.54528191 |
| 82 | 0.375519541; 0.376115439 | 1.92; 1.92 | 0.536628352 | 0.536628352 |
| 83 | 0.375519541; 0.376115439; 0.375519541; 0.376115439 | 2.42; 2.42; 2.68; 2.68 | 0.604378471 | 0.604378471 |
| 84 | 0.375519541; 0.376115439; 0.375519541; 0.376115439 | 2.42; 2.42; 2.68; 2.68 | 0.584997109 | 0.584997109 |
| 85 | 0.069549998; 0.082088441; 0.069549998; 0.082088441 | 30.77; 30.77; 30.77; 30.77 | 0.577457295 | 0.577457295 |
| 86 | 0.069549998; 0.082088441; 0.069549998; 0.082088441 | 30.77; 30.77; 30.77; 30.77 | 0.529824851 | 0.529824851 |
| 87 | 0.375519541; 0.376115439 | 5.26; 5.26 | 0.569001696 | 0.569001696 |
| 88 | 0.375519541; 0.376115439 | 5.26; 5.26 | 0.502346815 | 0.502346815 |
| 89 | 0.375519541; 0.376115439; 0.375519541; 0.376115439 | 8.33; 2.08; 10; 2.5 | 0.575891896 | 0.575891896 |
| 90 | 0.375519541; 0.376115439; 0.375519541; 0.376115439 | 8.33; 2.08; 10; 2.5 | 0.543154472 | 0.543154472 |
| 91 | 0.357678624; 0.013656923; 0.357678624; 0.013656923 | 13.51; 21.62; 13.51; 21.62 | 0.839780241 | 0.839780241 |
| 92 | 0.357678624; 0.013656923; 0.357678624; 0.013656923 | 13.51; 21.62; 13.51; 21.62 | 0.778361716 | 0.778361716 |
| 93 | 0.000109745; 0.00028483; 1.35e−09; 4.87e−09 | 38.1; 38.1; 100; 100 | 0.683977936 | 0.683977936 |
| 94 | 0.000109745; 0.00028483; 1.35e−09; 4.87e−09 | 38.1; 38.1; 100; 100 | 0.589298368 | 0.589298368 |
| 95 | 0.375519541; 0.217379602 | 6.9; 17.24 | 0.548467044 | 0.548467044 |
| 96 | 0.375519541; 0.217379602 | 6.9; 17.24 | 0.495803892 | 0.495803892 |
| 97 | 0.375519541; 0.376115439; 0.375519541; 0.376115439 | 5.41; 5.41; 5.88; 5.88 | 0.760795331 | 0.760795331 |
| 98 | 0.375519541; 0.376115439; 0.375519541; 0.376115439 | 5.41; 5.41; 5.88; 5.88 | 0.635541076 | 0.635541076 |
| 99 | 0.242080288; 0.077749847 | 20; 25 | 1.005383323 | 1.005383323 |
| 100 | 0.242080288; 0.077749847 | 20; 25 | 0.876730419 | 0.876730419 |
| 101 | NA | NA | 0.616499755 | 0.616499755 |
| 102 | NA | NA | 0.49510704 | 0.49510704 |
| 103 | 0.375519541; 0.376115439 | 11.54; 11.54 | 0.716763408 | 0.716763408 |
| 104 | 0.375519541; 0.376115439 | 11.54; 11.54 | 0.599380997 | 0.599380997 |
| 105 | NA | NA | 0.656992374 | 0.656992374 |
| 106 | NA | NA | 0.50757894 | 0.50757894 |
| 107 | 0.375519541; 0.376115439 | 12; 16 | 0.840543337 | 0.840543337 |
| 108 | 0.375519541; 0.376115439 | 12; 16 | 0.786719361 | 0.786719361 |
| 109 | NA | NA | 0.657267171 | 0.657267171 |
| 110 | NA | NA | 0.630565161 | 0.630565161 |
| 111 | 0.375519541; 0.376115439; 0.375519541; 0.376115439 | 4.55; 4.55; 5.26; 5.26 | 0.635562953 | 0.635562953 |
| 112 | 0.375519541; 0.376115439; 0.375519541; 0.376115439 | 4.55; 4.55; 5.26; 5.26 | 0.533287999 | 0.533287999 |

TABLE 1.b4

| | t | P.Value | adj.P.Val | B | FC | FC_1 | LS |
|---|---|---|---|---|---|---|---|
| 53 | 5.778191883 | 0.0000895 | 0.001353955 | 1.456679722 | 1.767314318 | 1.767314318 | 1 |
| 54 | 6.892181385 | 0.0000168 | 0.000246011 | 3.099524657 | 1.57770062 | 1.57770062 | 1 |
| 55 | 9.253302738 | 0.000000833 | 0.0000357 | 6.19242406 | 1.521558567 | 1.521558567 | 1 |
| 56 | 11.26586399 | 0.000000103 | 0.0000188 | 8.334293711 | 1.424030952 | 1.424030952 | 1 |
| 57 | 10.28202262 | 0.000000278 | 0.0000341 | 7.34348108 | 1.777344217 | 1.777344217 | 1 |
| 58 | 9.413999651 | 0.000000693 | 0.0000319 | 6.379439954 | 1.629171467 | 1.629171467 | 1 |
| 59 | 10.11175044 | 0.000000332 | 0.000038 | 7.163032837 | 1.487200288 | 1.487200288 | 1 |
| 60 | 11.94636528 | 0.0000000516 | 0.00000675 | 9.003842662 | 1.441196694 | 1.441196694 | 1 |
| 61 | 24.58135563 | 0.0000000000137 | 0.000000456 | 16.37874866 | 1.738925843 | 1.738925843 | 1 |
| 62 | 15.25333763 | 0.00000000327 | 0.00000161 | 11.70817215 | 1.640629652 | 1.640629652 | 1 |
| 63 | 7.860091111 | 0.00000465 | 0.000194825 | 4.490099359 | 1.463673189 | 1.463673189 | 1 |
| 64 | 5.522644599 | 0.00013213 | 0.001008571 | 0.969392732 | 1.43314474 | 1.43314474 | 1 |
| 65 | 18.32758338 | 0.000000000417 | 0.00000139 | 13.52750828 | 1.704625501 | 1.704625501 | 1 |
| 66 | 13.94718949 | 0.00000000907 | 0.00000273 | 10.72148372 | 1.555547865 | 1.555547865 | 1 |
| 67 | 11.52508667 | 0.0000000798 | 0.0000163 | 8.581472574 | 1.551367132 | 1.551367132 | 1 |
| 68 | 10.08307691 | 0.000000332 | 0.0000201 | 7.12980296 | 1.481587756 | 1.481587756 | 1 |
| 69 | 9.299955364 | 0.000000813 | 0.0000651 | 6.263268508 | 1.663764933 | 1.663764933 | 1 |
| 70 | 9.505890351 | 0.000000625 | 0.0000298 | 6.485169411 | 1.455368935 | 1.455368935 | 1 |
| 71 | 5.824949583 | 0.0000832 | 0.001291332 | 1.531472866 | 1.479610205 | 1.479610205 | 1 |
| 72 | 4.959175271 | 0.000332747 | 0.001973317 | 0.016938829 | 1.46801104 | 1.46801104 | 1 |
| 73 | 9.757225935 | 0.000000488 | 0.0000478 | 6.778287569 | 1.715238465 | 1.715238465 | 1 |
| 74 | 10.54534743 | 0.000000204 | 0.0000152 | 7.622959726 | 1.465280982 | 1.465280982 | 1 |
| 75 | 9.815136335 | 0.000000444 | 0.0000241 | 6.834662497 | 1.59098995 | 1.59098995 | 1 |
| 76 | 9.53516435 | 0.000000623 | 0.0000554 | 6.530885843 | 1.527911871 | 1.527911871 | 1 |
| 77 | 17.23990268 | 0.00000000801 | 0.000000846 | 13.04055978 | 1.684822255 | 1.684822255 | 1 |
| 78 | 10.60096551 | 0.000000199 | 0.0000282 | 7.674168825 | 1.633098177 | 1.633098177 | 1 |
| 79 | 12.12630571 | 0.0000000455 | 0.000012 | 9.134087029 | 1.588551561 | 1.588551561 | 1 |
| 80 | 9.576235943 | 0.000000578 | 0.0000284 | 6.5655214 | 1.498328734 | 1.498328734 | 1 |
| 81 | 13.7603685 | 0.000000011 | 0.00000579 | 10.50364376 | 1.459305472 | 1.459305472 | 1 |
| 82 | 7.554087927 | 0.00000679 | 0.00013468 | 4.036394527 | 1.450578481 | 1.450578481 | 1 |
| 83 | 17.27604989 | 0.000000000782 | 0.000000844 | 13.06312691 | 1.52032364 | 1.52032364 | 1 |
| 84 | 20.77446481 | 0.0000000000975 | 0.00000086 | 14.78427402 | 1.500035983 | 1.500035983 | 1 |
| 85 | 9.476856238 | 0.000000646 | 0.0000303 | 6.451857113 | 1.492216944 | 1.492216944 | 1 |
| 86 | 4.701168771 | 0.000520651 | 0.00463369 | −0.350283943 | 1.443753907 | 1.443753907 | 1 |
| 87 | 7.730294698 | 0.00000551 | 0.000216233 | 4.318032369 | 1.483496677 | 1.483496677 | 1 |
| 88 | 10.01953707 | 0.000000355 | 0.0000209 | 7.060443564 | 1.416515919 | 1.416515919 | 1 |
| 89 | 9.902517743 | 0.000000416 | 0.0000434 | 6.937463666 | 1.490598689 | 1.490598689 | 1 |
| 90 | 15.22110504 | 0.00000000335 | 0.00000164 | 11.68495444 | 1.457155126 | 1.457155126 | 1 |
| 91 | 14.63678274 | 0.00000000549 | 0.0000041 | 11.16741021 | 1.789777493 | 1.789777493 | 1 |
| 92 | 11.54363869 | 0.0000000755 | 0.00000841 | 8.623396595 | 1.715182054 | 1.715182054 | 1 |
| 93 | 6.528038663 | 0.0000289 | 0.000636125 | 2.618471694 | 1.606563423 | 1.606563423 | 1 |
| 94 | 7.982440923 | 0.00000388 | 0.0000941 | 4.612400208 | 1.504514872 | 1.504514872 | 1 |
| 95 | 3.325957648 | 0.006084037 | 0.025942826 | −2.841364307 | 1.462530837 | 1.462530837 | 1 |
| 96 | 3.959937544 | 0.001899013 | 0.007183188 | −1.766742449 | 1.41010627 | 1.41010627 | 1 |
| 97 | 13.39746234 | 0.0000000143 | 0.00000343 | 10.27616465 | 1.694424472 | 1.694424472 | 1 |
| 98 | 8.949997713 | 0.00000122 | 0.000084 | 5.854134441 | 1.553520281 | 1.553520281 | 1 |
| 99 | 16.50897497 | 0.00000000139 | 0.00000219 | 12.44435513 | 2.007476811 | 2.007476811 | 1 |
| 100 | 8.460462909 | 0.00000213 | 0.0000643 | 5.228560837 | 1.836209179 | 1.836209179 | 1 |
| 101 | 11.89527738 | 0.0000000563 | 0.0000134 | 8.925067536 | 1.533150958 | 1.533150958 | 1 |
| 102 | 11.69713138 | 0.0000000653 | 0.00000768 | 8.769894288 | 1.409425322 | 1.409425322 | 1 |
| 103 | 12.45056206 | 0.0000000326 | 0.00000533 | 9.462780811 | 1.643490831 | 1.643490831 | 1 |
| 104 | 13.56747572 | 0.0000000129 | 0.00000631 | 10.35127768 | 1.515066372 | 1.515066372 | 1 |
| 105 | 14.74583165 | 0.00000000505 | 0.00000398 | 11.24686929 | 1.576792013 | 1.576792013 | 1 |
| 106 | 9.135658327 | 0.000000954 | 0.0000389 | 6.053777075 | 1.421662428 | 1.421662428 | 1 |
| 107 | 13.74582787 | 0.0000000112 | 0.00000579 | 10.49223964 | 1.790724424 | 1.790724424 | 1 |
| 108 | 14.26887695 | 0.000000007 | 0.00000243 | 10.97352139 | 1.725147074 | 1.725147074 | 1 |
| 109 | 12.63211522 | 0.0000000277 | 0.00000492 | 9.6235096 | 1.577092381 | 1.577092381 | 1 |
| 110 | 6.351029156 | 0.0000375 | 0.000753966 | 2.35144083 | 1.548171355 | 1.548171355 | 1 |
| 111 | 11.79956703 | 0.0000000592 | 0.00000729 | 8.866629894 | 1.553543839 | 1.553543839 | 1 |
| 112 | 6.37193688 | 0.0000363 | 0.000737519 | 2.383212703 | 1.44722376 | 1.44722376 | 1 |

TABLE 1.b5

| | Loop Detected | Probe sequence 60 mer | Probe Location Chr |
|---|---|---|---|
| 53 | mHC | CCACGGAGGGGTCCTTCTGAACTGCAATTCGAAACAGTATTTTCAAAAATAAAATAGACC (SEQ ID NO: 158) | 9 |
| 54 | sHC | CCACGGAGGGGTCCTTCTGAACTGCAATTCGAAACAGTATTTTCAAAAATAAAATAGACC (SEQ ID NO: 158) | 9 |
| 55 | sHC | AAAGGAAATATTAAGTATGGAAATACTTTCGACACACAATTATGACACTACTAGTAATAG (SEQ ID NO: 160) | X |

TABLE 1.b5-continued

| | Loop Detected | Probe sequence 60 mer | Probe Location Chr |
|---|---|---|---|
| 56 | mHC | AAAGGAAATATTAAGTATGGAAATACTTTCGACACACAATTATGACACTACTAGTAATAG (SEQ ID NO: 160) | X |
| 57 | mHC | CAATTCAGATAATAATACTTTTATAATGTCGACAGAGCTACATTAAAAAGGAGAATCTCC (SEQ ID NO: 162) | 2 |
| 58 | sHC | CAATTCAGATAATAATACTTTTATAATGTCGACAGAGCTACATTAAAAAGGAGAATCTCC (SEQ ID NO: 162) | 2 |
| 59 | mHC | GCCCACTAAATAGTAATATTAGGATCTATCGATTTCCCACATGGAATATACAGATTTAGC (SEQ ID NO: 164) | 9 |
| 60 | sHC | GCCCACTAAATAGTAATATTAGGATCTATCGATTTCCCACATGGAATATACAGATTTAGC (SEQ ID NO: 164) | 9 |
| 61 | mHC | CAAGAAGAAGGGATAAAATACTACTTCTTCGAAAGTGACAATAACCTCCATAATTAAGGG (SEQ ID NO: 166) | 2 |
| 62 | sHC | CAAGAAGAAGGGATAAAATACTACTTCTTCGAAAGTGACAATAACCTCCATAATTAAGGG (SEQ ID NO: 166) | 2 |
| 63 | mHC | TTATATGTTTTAAATAACAAAAATTATATCGATCATCTATCTACATGTGTGTATCTCTAT (SEQ ID NO: 168) | 3 |
| 64 | sHC | TTATATGTTTTAAATAACAAAAATTATATCGATCATCTATCTACATGTGTGTATCTCTAT (SEQ ID NO: 168) | 3 |
| 65 | mHC | CAAGAAGAAGGGATAAAATACTACTTCTTCGAGATAATTTGAGATTAAATTGACAACATA (SEQ ID NO: 170) | 2 |
| 66 | sHC | CAAGAAGAAGGGATAAAATACTACTTCTTCGAGATAATTTGAGATTAAATTGACAACATA (SEQ ID NO: 170) | 2 |
| 67 | mHC | GGAAATAAACAGAGGGATTTTGTTTATATCGATTATCTTACATGTTTCTTAGAATGAATG (SEQ ID NO: 172) | 9 |
| 68 | sHC | GGAAATAAACAGAGGGATTTTGTTTATATCGATTATCTTACATGTTTCTTAGAATGAATG (SEQ ID NO: 172) | 9 |
| 69 | mHC | TAGATGAATAAATTTAGACCTTATTAGGTCGAAAAAACTGGAAAAAAAAATTGTCAAGTG (SEQ ID NO: 174) | 3 |
| 70 | sHC | TAGATGAATAAATTTAGACCTTATTAGGTCGAAAAAACTGGAAAAAAAAATTGTCAAGTG (SEQ ID NO: 174) | 3 |
| 71 | mHC | CTACTCTTATTCTTCTCTCAAGAAATTATCGATGTTTGAGAAATATACAAATAAAGTAAT (SEQ ID NO: 176) | 13 |
| 72 | sHC | CTACTCTTATTCTTCTCTCAAGAAATTATCGATGTTTGAGAAATATACAAATAAAGTAAT (SEQ ID NO: 176) | 13 |
| 73 | mHC | CAATATTATATGTAGAGATTCTTTCATATCGATTAAGAATTACCGTCTTAAGAAAATCTC (SEQ ID NO: 178) | 2 |
| 74 | sHC | CAATATTATATGTAGAGATTCTTTCATATCGATTAAGAATTACCGTCTTAAGAAAATCTC (SEQ ID NO: 178) | 2 |
| 75 | sHC | AGCACAAAATAATATAGCATAAAACATATCGACTTATCTGATTTTCACCTCAAATGACCT (SEQ ID NO: 180) | 1 |
| 76 | mHC | AGCACAAAATAATATAGCATAAAACATATCGACTTATCTGATTTTCACCTCAAATGACCT (SEQ ID NO: 180) | 1 |
| 77 | sHC | TATTTGTAAATATTTTAGTATTTACAAATCGATTTTCATAATATCCTAAATATGATATAG (SEQ ID NO: 182) | 8 |
| 78 | mHC | TATTTGTAAATATTTTAGTATTTACAAATCGATTTTCATAATATCCTAAATATGATATAG (SEQ ID NO: 182) | 8 |
| 79 | mHC | TACATTTTTAGCTCATCATAAAAGATATTCGATTATTTAGAAAAAGAAATGAAGAGATGG (SEQ ID NO: 184) | 1 |
| 80 | sHC | TACATTTTTAGCTCATCATAAAAGATATTCGATTATTTAGAAAAAGAAATGAAGAGATGG (SEQ ID NO: 184) | 1 |

TABLE 1.b5-continued

| Loop Detected | Probe sequence 60 mer | Probe Location Chr |
|---|---|---|
| 81 mHC | ATGAAATAGAGTGTTAGAATTTAATGAATCGAACTGATTAATAATTTTCTTCTGAACCCC (SEQ ID NO: 186) | 1 |
| 82 sHC | ATGAAATAGAGTGTTAGAATTTAATGAATCGAACTGATTAATAATTTTCTTCTGAACCCC (SEQ ID NO: 186) | 1 |
| 83 sHC | TGGTAAATTGGAGCAGGTGACCTGGGAGTCGAGGCAGCTGCAGGATTTAAATTGGCTGAG (SEQ ID NO: 188) | 1 |
| 84 mHC | TGGTAAATTGGAGCAGGTGACCTGGGAGTCGAGGCAGCTGCAGGATTTAAATTGGCTGAG (SEQ ID NO: 188) | 1 |
| 85 sHC | TTAACATCTTATTCTAAAAAATAGTTTATCGAAAAATCAGAAATCAGTAACCTAATACTG (SEQ ID NO: 190) | 12 |
| 86 mHC | TTAACATCTTATTCTAAAAAATAGTTTATCGAAAAATCAGAAATCAGTAACCTAATACTG (SEQ ID NO: 190) | 12 |
| 87 mHC | GGTAATATTTAACTATAGTTCTCAATACTCGAGTGATAAATATTTTGCCAACTTATAAGG (SEQ ID NO: 192) | 14 |
| 88 sHC | GGTAATATTTAACTATAGTTCTCAATACTCGAGTGATAAATATTTTGCCAACTTATAAGG (SEQ ID NO: 192) | 14 |
| 89 mHC | TTTTCTCAGCTAAGAAAACAAATGAGATTCGAGTCATTAATTCTTGCTTCTTAACTGCTT (SEQ ID NO: 194) | 2 |
| 90 sHC | TTTTCTCAGCTAAGAAAACAAATGAGATTCGAGTCATTAATTCTTGCTTCTTAACTGCTT (SEQ ID NO: 194) | 2 |
| 91 mHC | AAAGATATAATGTTTCACATATTTTAAATCGATATATTCTACAAACTGCTTTATTGTAGA (SEQ ID NO: 196) | 4 |
| 92 sHC | AAAGATATAATGTTTCACATATTTTAAATCGATATATTCTACAAACTGCTTTATTGTAGA (SEQ ID NO: 196) | 4 |
| 93 mHC | CCACGGAGGGGTCCTTCTGAACTGCAATTCGACATCCAAGGTCTTCACAATGTGGCTGAC (SEQ ID NO: 198) | 9 |
| 94 sHC | CCACGGAGGGGTCCTTCTGAACTGCAATTCGACATCCAAGGTCTTCACAATGTGGCTGAC (SEQ ID NO: 198) | 9 |
| 95 mHC | CACACTTGAGCTCATTGTAAACCAAAGCTCGAGAGCGGTCCCGTGGGGGCGGTGTTACTC (SEQ ID NO: 200) | X |
| 96 sHC | CACACTTGAGCTCATTGTAAACCAAAGCTCGAGAGCGGTCCCGTGGGGGCGGTGTTACTC (SEQ ID NO: 200) | X |
| 97 sHC | AAAGGAAATATTAAGTATGGAAATACTTTCGAGAAAGAAACAAATACAGCTAGGAAGCAT (SEQ ID NO: 202) | X |
| 98 mHC | AAAGGAAATATTAAGTATGGAAATACTTTCGAGAAAGAAACAAATACAGCTAGGAAGCAT (SEQ ID NO: 202) | X |
| 99 mHC | AATTATTCAAAAAGACACAATTGTTTTCTCGAACATGTTTTAGTGATTTATATTCACTCA (SEQ ID NO: 204) | 6 |
| 100 sHC | AATTATTCAAAAAGACACAATTGTTTTCTCGAACATGTTTTAGTGATTTATATTCACTCA (SEQ ID NO: 204) | 6 |
| 101 mHC | AATTCCATATTTTCTAGAAAAAAAAAATCGATTTTAGAAGACTTGAAAAAGTTGTAATT (SEQ ID NO: 206) | 21 |
| 102 sHC | AATTCCATATTTTCTAGAAAACAAAAAATCGATTTTAGAAGACTTGAAAAAGTTGTAATT (SEQ ID NO: 206) | 21 |
| 103 sHC | AAACTATGTAAAGAAAATTTGAAGAATTTCGATTTTTATTGCCAGAAACGACTCTTAAAG (SEQ ID NO: 208) | 5 |
| 104 mHC | AAACTATGTAAAGAAAATTTGAAGAATTTCGATTTTTATTGCCAGAAACGACTCTTAAAG (SEQ ID NO: 208) | 5 |
| 105 mHC | CATGTATTTATATTAATATCAAACAAGATCGACCATTATAAAGATTTAACTATTTTATGC (SEQ ID NO: 210) | 1 |
| 106 sHC | CATGTATTTATATTAATATCAAACAAGATCGACCATTATAAAGATTTAACTATTTTATGC | 1 |

TABLE 1.b5-continued

| Loop Detected | Probe sequence 60 mer | Probe Location Chr |
|---|---|---|
| | (SEQ ID NO: 210) | |
| 107 mHC | ATTTTTTTTTATTATTATACTTTTAAGTTCGAATCTTTCTAAAACACAGTAAACTCAAAC (SEQ ID NO: 212) | 11 |
| 108 sHC | ATTTTTTTTTATTATTATACTTTTAAGTTCGAATCTTTCTAAAACACAGTAAACTCAAAC (SEQ ID NO: 212) | 11 |
| 109 sHC | TATGTATTTATATATGATTACCATTATGTCGATGAATCAACATTTTCCAAAATAATACAT (SEQ ID NO: 214) | 12 |
| 110 mHC | TATGTATTTATATATGATTACCATTATGTCGATGAATCAACATTTTCCAAAATAATACAT (SEQ ID NO: 214) | 12 |
| 111 sHC | CCAATATGTATTCAAATTAAATACGTATTCGACTTTATACTATATGAGAATAAAAAAAGA (SEQ ID NO: 216) | 13 |
| 112 mHC | CCAATATGTATTCAAATTAAATACGTATTCGACTTTATACTATATGAGAATAAAAAAAGA (SEQ ID NO: 216) | 13 |

TABLE 1.b6

| | Probe Location | | | | 4 kb Sequence Location | | | |
|---|---|---|---|---|---|---|---|---|
| | Start1 | End1 | Start2 | End2 | Chr | Start1 | End1 | Start2 | End2 |
| 53 | 38686830 | 38686861 | 38762460 | 38762491 | 9 | 38682860 | 38686861 | 38758490 | 38762491 |
| 54 | 38686830 | 38686861 | 38762460 | 38762491 | 9 | 38682860 | 38686861 | 38758490 | 38762491 |
| 55 | 38264181 | 38264212 | 38327821 | 38327852 | X | 38260211 | 38264212 | 38327821 | 38331822 |
| 56 | 38264181 | 38264212 | 38327821 | 38327852 | X | 38260211 | 38264212 | 38327821 | 38331822 |
| 57 | 21304800 | 21304831 | 21387147 | 21387178 | 2 | 21300830 | 21304831 | 21383177 | 21387178 |
| 58 | 21304800 | 21304831 | 21387147 | 21387178 | 2 | 21300830 | 21304831 | 21383177 | 21387178 |
| 59 | 28339600 | 28339631 | 28367003 | 28367034 | 9 | 28335630 | 28339631 | 28367003 | 28371004 |
| 60 | 28339600 | 28339631 | 28367003 | 28367034 | 9 | 28335630 | 28339631 | 28367003 | 28371004 |
| 61 | 21331973 | 21332004 | 21387178 | 21387209 | 2 | 21328003 | 21332004 | 21387178 | 21391179 |
| 62 | 21331973 | 21332004 | 21387178 | 21387209 | 2 | 21328003 | 21332004 | 21387178 | 21391179 |
| 63 | 127239888 | 127239919 | 127301511 | 127301542 | 3 | 127239888 | 127243889 | 127301511 | 127305512 |
| 64 | 127239888 | 127239919 | 127301511 | 127301542 | 3 | 127239888 | 127243889 | 127301511 | 127305512 |
| 65 | 21331973 | 21332004 | 21390529 | 21390560 | 2 | 21328003 | 21332004 | 21386559 | 21390560 |
| 66 | 21331973 | 21332004 | 21390529 | 21390560 | 2 | 21328003 | 21332004 | 21386559 | 21390560 |
| 67 | 105415801 | 105415832 | 105451606 | 105451637 | 9 | 105415801 | 105419802 | 105447636 | 105451637 |
| 68 | 105415801 | 105415832 | 105451606 | 105451637 | 9 | 105415801 | 105419802 | 105447636 | 105451637 |
| 69 | 37917509 | 37917540 | 37993419 | 37993450 | 3 | 37913539 | 37917540 | 37993419 | 37997420 |
| 70 | 37917509 | 37917540 | 37993419 | 37993450 | 3 | 37913539 | 37917540 | 37993419 | 37997420 |
| 71 | 87503022 | 87503053 | 87529716 | 87529747 | 13 | 87499052 | 87503053 | 87525746 | 87529747 |
| 72 | 87503022 | 87503053 | 87529716 | 87529747 | 13 | 87499052 | 87503053 | 87525746 | 87529747 |
| 73 | 209626724 | 209626755 | 209662023 | 209662054 | 2 | 209622754 | 209626755 | 209658053 | 209662054 |
| 74 | 209626724 | 209626755 | 209662023 | 209662054 | 2 | 209622754 | 209626755 | 209658053 | 209662054 |
| 75 | 213896516 | 213896547 | 213957996 | 213958027 | 1 | 213896516 | 213900517 | 213954026 | 213958027 |
| 76 | 213896516 | 213896547 | 213957996 | 213958027 | 1 | 213896516 | 213900517 | 213954026 | 213958027 |
| 77 | 13602479 | 13602510 | 13658646 | 13658677 | 8 | 13602479 | 13606480 | 13658646 | 13662647 |
| 78 | 13602479 | 13602510 | 13658646 | 13658677 | 8 | 13602479 | 13606480 | 13658646 | 13662647 |
| 79 | 13873315 | 13873346 | 13952953 | 13952984 | 1 | 13873315 | 13877316 | 13948983 | 13952984 |
| 80 | 13873315 | 13873346 | 13952953 | 13952984 | 1 | 13873315 | 13877316 | 13948983 | 13952984 |
| 81 | 240094653 | 240094684 | 240158711 | 240158742 | 1 | 240090683 | 240094684 | 240158711 | 240162712 |
| 82 | 240094653 | 240094684 | 240158711 | 240158742 | 1 | 240090683 | 240094684 | 240158711 | 240162712 |
| 83 | 36409666 | 36409697 | 36433268 | 36433299 | 1 | 36409666 | 36413667 | 36433268 | 36437269 |
| 84 | 36409666 | 36409697 | 36433268 | 36433299 | 1 | 36409666 | 36413667 | 36433268 | 36437269 |
| 85 | 75070822 | 75070853 | 75136236 | 75136267 | 12 | 75070822 | 75074823 | 75136236 | 75140237 |
| 86 | 75070822 | 75070853 | 75136236 | 75136267 | 12 | 75070822 | 75074823 | 75136236 | 75140237 |
| 87 | 50690632 | 50690663 | 50737547 | 50737578 | 14 | 50686662 | 50690663 | 50737547 | 50741548 |
| 88 | 50690632 | 50690663 | 50737547 | 50737578 | 14 | 50686662 | 50690663 | 50737547 | 50741548 |
| 89 | 11479893 | 11479924 | 11532162 | 11532193 | 2 | 11479893 | 11483894 | 11532162 | 11536163 |
| 90 | 11479893 | 11479924 | 11532162 | 11532193 | 2 | 11479893 | 11483894 | 11532162 | 11536163 |
| 91 | 37796365 | 37796396 | 37862832 | 37862863 | 4 | 37796365 | 37800366 | 37862832 | 37866833 |
| 92 | 37796365 | 37796396 | 37862832 | 37862863 | 4 | 37796365 | 37800366 | 37862832 | 37866833 |
| 93 | 38686830 | 38686861 | 38742977 | 38743008 | 9 | 38682860 | 38686861 | 38739007 | 38743008 |
| 94 | 38686830 | 38686861 | 38742977 | 38743008 | 9 | 38682860 | 38686861 | 38739007 | 38743008 |
| 95 | 115884702 | 115884733 | 115945548 | 115945579 | X | 115884702 | 115888703 | 115941578 | 115945579 |
| 96 | 115884702 | 115884733 | 115945548 | 115945579 | X | 115884702 | 115888703 | 115941578 | 115945579 |
| 97 | 38264181 | 38264212 | 38333688 | 38333719 | X | 38260211 | 38264212 | 38329718 | 38333719 |
| 98 | 38264181 | 38264212 | 38333688 | 38333719 | X | 38260211 | 38264212 | 38329718 | 38333719 |
| 99 | 84732471 | 84732502 | 84786605 | 84786636 | 6 | 84728501 | 84732502 | 84782635 | 84786636 |

TABLE 1.b6-continued

| | Probe Location | | | | 4 kb Sequence Location | | | |
|---|---|---|---|---|---|---|---|---|
| | Start1 | End1 | Start2 | End2 | Chr | Start1 | End1 | Start2 | End2 |
| 100 | 84732471 | 84732502 | 84786605 | 84786636 | 6 | 84728501 | 84732502 | 84782635 | 84786636 |
| 101 | 15444025 | 15444056 | 15503850 | 15503881 | 21 | 15444025 | 15448026 | 15499880 | 15503881 |
| 102 | 15444025 | 15444056 | 15503850 | 15503881 | 21 | 15444025 | 15448026 | 15499880 | 15503881 |
| 103 | 127434266 | 127434297 | 127490884 | 127490915 | 5 | 127434266 | 127438267 | 127486914 | 127490915 |
| 104 | 127434266 | 127434297 | 127490884 | 127490915 | 5 | 127434266 | 127438267 | 127486914 | 127490915 |
| 105 | 207936305 | 207936336 | 207957832 | 207957863 | 1 | 207936305 | 207940306 | 207957832 | 207961833 |
| 106 | 207936305 | 207936336 | 207957832 | 207957863 | 1 | 207936305 | 207940306 | 207957832 | 207961833 |
| 107 | 49148928 | 49148959 | 49200052 | 49200083 | 11 | 49144958 | 49148959 | 49200052 | 49204053 |
| 108 | 49148928 | 49148959 | 49200052 | 49200083 | 11 | 49144958 | 49148959 | 49200052 | 49204053 |
| 109 | 83942863 | 83942894 | 83957569 | 83957600 | 12 | 83938893 | 83942894 | 83953599 | 83957600 |
| 110 | 83942863 | 83942894 | 83957569 | 83957600 | 12 | 83938893 | 83942894 | 83953599 | 83957600 |
| 111 | 98189604 | 98189635 | 98215516 | 98215547 | 13 | 98185634 | 98189635 | 98215516 | 98219517 |
| 112 | 98189604 | 98189635 | 98215516 | 98215547 | 13 | 98185634 | 98189635 | 98215516 | 98219517 |

TABLE 1.b7

| | Probe | PCR-Primer1_ID | PCR_Primer1 |
|---|---|---|---|
| 53 | ORF11_9_38681931_38686861_38760727_38762491_FF | OBD159_105 | GCCAGAAGTTCACAGGCAGGGTG (SEQ ID NO: 72) |
| 54 | ORF11_9_38681931_38686861_38760727_38762491_FF | OBD159_105 | GCCAGAAGTTCACAGGCAGGGTG (SEQ ID NO: 72) |
| 55 | ORF11_X_38261316_38264212_38327821_38333719_FR | OBD159_109 | TTACAGGCGTGAGCCACCAAGCC (SEQ ID NO: 220) |
| 56 | ORF11_X_38261316_38264212_38327821_38333719_FR | OBD159_109 | TTACAGGCGTGAGCCACCAAGCC (SEQ ID NO: 220) |
| 57 | ORF110_2_21300802_21304831_21382106_21387178_FF | OBD159_113 | ATGGCGAACAGAGTGATGGAGGTGAT (SEQ ID NO: 222) |
| 58 | ORF110_2_21300802_21304831_21382106_21387178_FF | OBD159_113 | ATGGCGAACAGAGTGATGGAGGTGAT (SEQ ID NO: 222) |
| 59 | ORF111_9_28333777_28339631_28367003_28368817_FR | OBD159_117 | CCAGTAGTATGGTGGCTGTGAATA (SEQ ID NO: 224) |
| 60 | ORF111_9_28333777 28339631_28367003_28368817_FR | OBD159_117 | CCAGTAGTATGGTGGCTGTGAATA (SEQ ID NO: 224) |
| 61 | ORF112_2_21325579_21332004_21387178_21390560_FR | OBD159_121 | GAGGGAGAGAGACTGAAGGCAGG (SEQ ID NO: 226) |
| 62 | ORF112_2_21325579_21332004_21387178_21390560_FR | OBD159_121 | GAGGGAGAGAGACTGAAGGCAGG (SEQ ID NO: 226) |
| 63 | ORF112_3_127239888_127246012_127301511_127306201_RR | OBD159_125 | TCACCCTCTGCCTCTGTGTTCTCATC (SEQ ID NO: 228) |
| 64 | ORF112_3_127239888_127246012_127301511_127306201_RR | OBD159_125 | TCACCCTCTGCCTCTGTGTTCTCATC (SEQ ID NO: 228) |
| 65 | ORF113_2_21325579_21332004_21387178_21390560_FF | OBD159_129 | GGAGAGAGACTGAAGGCAGGAATGCT (SEQ ID NO: 230) |
| 66 | ORF113_2_21325579_21332004_21387178_21390560_FF | OBD159_129 | GGAGAGAGACTGAAGGCAGGAATGCT (SEQ ID NO: 230) |
| 67 | ORF115_9_105415801_105419712_105449848_105451637_RF | OBD159_133 | GAAAATAACTTGGACTTCAGTGTT (SEQ ID NO: 232) |
| 68 | ORF115_9_105415801_105419712_105449848_105451637_RF | OBD159_133 | GAAAATAACTTGGACTTCAGTGTT (SEQ ID NO: 232) |
| 69 | ORF116_3_37914711_37917540_37993419 37999345_FR | OBD159_137 | ACTCAGTCCCCTCCCTCAGTAGC (SEQ ID NO: 234) |
| 70 | ORF116_3_37914711_37917540_37993419_37999345_FR | OBD159_137 | ACTCAGTCCCCTCCCTCAGTAGC (SEQ ID NO: 234) |

TABLE 1.b7-continued

| | Probe | PCR-Primer1_ID | PCR_Primer1 |
|---|---|---|---|
| 71 | ORF117_13_87499323_87503053_87526042_87529747_FF | OBD159_141 | ACAGGTAGGTAAACATTTCATAAA (SEQ ID NO: 236) |
| 72 | ORF117_13_87499323_87503053_87526042_87529747_FF | OBD159_141 | ACAGGTAGGTAAACATTTCATAAA (SEQ ID NO: 236) |
| 73 | ORF117_2_209621630_209626755_209659511_209662054_FF | OBD159_145 | CCATTCTTCCAGAGATGTCAAAACCC (SEQ ID NO: 238) |
| 74 | ORF117_2_209621630_209626755_209659511_209662054_FF | OBD159_145 | CCATTCTTCCAGAGATGTCAAAACCC (SEQ ID NO: 238) |
| 75 | ORF119_1_213896516_213907154_213954211_213958027_RF | OBD159_149 | GCTCCTGCCATTCAGTTACCATCTA (SEQ ID NO: 240) |
| 76 | ORF119_1_213896516_213907154_213954211_213958027_RF | OBD159_149 | GCTCCTGCCATTCAGTTACCATCTA (SEQ ID NO: 240) |
| 77 | ORF119_8_13602479_13607345_13658646_13661358_RR | OBD159_153 | ATACAGCCACTTCAACTTGTCCTAAT (SEQ ID NO: 242) |
| 78 | ORF119_8_13602479_13607345_13658646_13661358_RR | OBD159_153 | ATACAGCCACTTCAACTTGTCCTAAT (SEQ ID NO: 242) |
| 79 | ORF12_1_13873315_13874983_13945271_13952984_RF | OBD159_157 | TGCTGTGTGACCTTGGGATGTCC (SEQ ID NO: 244) |
| 80 | ORF12_1_13873315_13874983_13945271_13952984_RF | OBD159_157 | TGCTGTGTGACCTTGGGATGTCC (SEQ ID NO: 244) |
| 81 | ORF12_1_240091688_240094684_240158711_240162261_FR | OBD159_161 | GGTCAGTGTCAAGCAGTCCAATGAGT (SEQ ID NO: 246) |
| 82 | ORF12_1_240091688_240094684_240158711_240162261_FR | OBD159_161 | GGTCAGTGTCAAGCAGTCCAATGAGT (SEQ ID NO: 246) |
| 83 | ORF12_1_36409666_36411937_36433268_36434547_RR | OBD159_165 | GAAGCGAGTTGCTGTCACTGGAG (SEQ ID NO: 248) |
| 84 | ORF12_1_36409666_36411937_36433268_36434547_RR | OBD159_165 | GAAGCGAGTTGCTGTCACTGGAG (SEQ ID NO: 248) |
| 85 | ORF12_12_75070822_75072825_75136236_75139196_RR | OBD159_169 | GGGACACAAATAGACCAAGTAAAT (SEQ ID NO: 250) |
| 86 | ORF12_12_75070822_75072825_75136236_75139196_RR | OBD159_169 | GGGACACAAATAGACCAAGTAAAT (SEQ ID NO: 250) |
| 87 | ORF12_14_50687093_50690663_50737547_50743189_FR | OBD159_173 | GGTGAAATGGGATGGTGTGCTAT (SEQ ID NO: 252) |
| 88 | ORF12_14_50687093_50690663_50737547_50743189_FR | OBD159_173 | GGTGAAATGGGATGGTGTGCTAT (SEQ ID NO: 252) |
| 89 | ORF12_2_11479893_11482767_11532162_11535545_RR | OBD159_177 | CATAAACTCCTACCAACTAAGAAT (SEQ ID NO: 254) |
| 90 | ORF12_2_11479893_11482767_11532162_11535545_RR | OBD159_177 | CATAAACTCCTACCAACTAAGAAT (SEQ ID NO: 254) |
| 91 | ORF12_4_37796365_37802481_37862832_37864637_RR | OBD159_181 | AATAAATAGATACCATCCCAGAGC (SEQ ID NO: 256) |
| 92 | ORF12_4_37796365_37802481_37862832_37864637_RR | OBD159_181 | AATAAATAGATACCATCCCAGAGC (SEQ ID NO: 256) |
| 93 | ORF12_9_38681931_38686861_38738766_38743008_FF | OBD159_185 | CAGAAGTTCACAGGCAGGGTGTC (SEQ ID NO: 258) |
| 94 | ORF12_9_38681931_38686861_38738766_38743008_FF | OBD159_185 | CAGAAGTTCACAGGCAGGGTGTC (SEQ ID NO: 258) |
| 95 | ORF12_X_115884702_115886518_115936015_115945579_RF | OBD159_189 | CAGGAATCATTTGACACAATCCCC (SEQ ID NO: 260) |
| 96 | ORF12_X_115884702_115886518_115936015_115945579_RF | OBD159_189 | CAGGAATCATTTGACACAATCCCC (SEQ ID NO: 260) |

TABLE 1.b7-continued

| Probe | PCR-Primer1_ID | PCR_Primer1 |
|---|---|---|
| 97ORF12_X_38261316_38264212_38327821_38333719_FF | OBD159_193 | AAACAACTACTATCAGATGAGAAAT (SEQ ID NO: 262) |
| 98ORF12_X_38261316_38264212_38327821_38333719_FF | OBD159_193 | AAACAACTACTATCAGATGAGAAAT (SEQ ID NO: 262) |
| 99ORF123_6_84727932_84732502_84775145_84786636_FF | OBD159_197 | GGATGTGTGTGTTGATTCAGCCTTGT (SEQ ID NO: 264) |
| 100ORF123_6_84727932_84732502_84775145_84786636_FF | OBD159_197 | GGATGTGTGTGTTGATTCAGCCTTGT (SEQ ID NO: 264) |
| 101ORF125_21_15444025_15470065_15500094_15503881_RF | OBD159_201 | CTCTACCTGTATTGTTGGCTAATCAA (SEQ ID NO: 266) |
| 102ORF125_21_15444025_15470065_15500094_15503881_RF | OBD159_201 | CTCTACCTGTATTGTTGGCTAATCAA (SEQ ID NO: 266) |
| 103ORF127_5_127434266_127436041_127487600_127490915_RF | OBD159_205 | GGCAAAAGATTTATTAGGGACAACCA (SEQ ID NO: 268) |
| 104ORF127_5_127434266_127436041_127487600_127490915_RF | OBD159_205 | GGCAAAAGATTTATTAGGGACAACCA (SEQ ID NO: 268) |
| 105ORF13_1_207936305_207938059_207957832_207960627_RR | OBD159_209 | CAGAAATGTCAAAAGTAAGAGGCAA G (SEQ ID NO: 270) |
| 106ORF13_1_207936305_207938059_207957832_207960627_RR | OBD159_209 | CAGAAATGTCAAAAGTAAGAGGCAA G (SEQ ID NO: 270) |
| 107ORF13_11_49143461_49148959_49200052_49204610_FR | OBD159_213 | GGTTTCAGGACCACCCTCTACACCAA (SEQ ID NO: 272) |
| 108ORF13_11_49143461_49148959_49200052_49204610_FR | OBD159_213 | GGTTTCAGGACCACCCTCTACACCAA (SEQ ID NO: 272) |
| 109ORF13_12_83941063_83942894_83954032_83957600_FF | OBD159_217 | ACATATATTAATATAATAATGTA (SEQ ID NO: 274) |
| 110ORF13_12_83941063_83942894_83954032_83957600_FF | OBD159_217 | ACATATATTAATATAATAATGTA (SEQ ID NO: 274) |
| 111ORF13 13_98188349_98189635_98215516_98217335_FR | OBD159_221 | GAGCAGAACAGAAAGGAACTTGAGT A (SEQ ID NO: 276) |
| 112ORF13 13_98188349_98189635_98215516_98217335_FR | OBD159_221 | GAGCAGAACAGAAAGGAACTTGAGT A (SEQ ID NO: 276) |

TABLE 1.b8

| | PCR-Primer2_ID | PCR_Primer2 | Marker | GLMNET |
|---|---|---|---|---|
| 53 | OBD159_107 | GCCCTTGCCCTGTCTCAGAATCT (SEQ ID NO: 278) | OBD159_105_107 | -0.002149419 |
| 54 | OBD159_107 | GCCCTTGCCCTGTCTCAGAATCT (SEQ ID NO: 278) | OBD159_105_107 | -0.002149419 |
| 55 | OBD159_111 | CAGATGTTGGTTTAGATGCTGGG (SEQ ID NO: 280) | OBD159_109_111 | -0.002801859 |
| 56 | OBD159_111 | CAGATGTTGGTTTAGATGCTGGG (SEQ ID NO: 280) | OBD159_109_111 | -0.002801859 |
| 57 | OBD159_115 | TTCTGTGGAGGACCTGGGAAATACTC (SEQ ID NO: 282) | OBD159_113_115 | -0.00307575 |
| 58 | OBD159_115 | TTCTGTGGAGGACCTGGGAAATACTC (SEQ ID NO: 282) | OBD159_113_115 | -0.00307575 |
| 59 | OBD159_119 | CCAGAAAGAATGATGAATGTGTTC (SEQ ID NO: 284) | OBD159_117_119 | -0.001168646 |

TABLE 1.b8-continued

| | PCR-<br>Primer2_ID | PCR_Primer2 | Marker | GLMNET |
|---|---|---|---|---|
| 60 | OBD159_119 | CCAGAAAGAATGATGAATGTGTTC<br>(SEQ ID NO: 284) | OBD159_117_119 | -0.001168646 |
| 61 | OBD159_123 | GCTGGCTGTCCTCTAAAACTCTTA<br>(SEQ ID NO: 286) | OBD159_121_123 | -0.003274843 |
| 62 | OBD159_123 | GCTGGCTGTCCTCTAAAACTCTTA<br>(SEQ ID NO: 286) | OBD159_121_123 | -0.003274843 |
| 63 | OBD159_127 | CCCATTGGCATTCAGTAGAACACTTC<br>(SEQ ID NO: 288) | OBD159_125_127 | -0.000325793 |
| 64 | OBD159_127 | CCCATTGGCATTCAGTAGAACACTTC<br>(SEQ ID NO: 288) | OBD159_125_127 | -0.000325793 |
| 65 | OBD159_131 | GATTGAAGGAGAGAGACTAAAGACGC<br>(SEQ ID NO: 290) | OBD159_129_131 | -0.002905869 |
| 66 | OBD159_131 | GATTGAAGGAGAGAGACTAAAGACGC<br>(SEQ ID NO: 290) | OBD159_129_131 | -0.002905869 |
| 67 | OBD159_135 | TTCAGTCAATCCTTTCAGAGAATA<br>(SEQ ID NO: 292) | OBD159_133_135 | -0.003158055 |
| 68 | OBD159_135 | TTCAGTCAATCCTTTCAGAGAATA<br>(SEQ ID NO: 292) | OBD159_133_135 | -0.003158055 |
| 69 | OBD159_139 | GAGTGGGTTGGGCAGATTAGGCA<br>(SEQ ID NO: 294) | OBD159_137_139 | -0.001264904 |
| 70 | OBD159_139 | GAGTGGGTTGGGCAGATTAGGCA<br>(SEQ ID NO: 294) | OBD159_137_139 | -0.001264904 |
| 71 | OBD159_143 | ATCTCAGGTAACTTGATTCACAAAG<br>(SEQ ID NO: 296) | OBD159_141_143 | -0.001918388 |
| 72 | OBD159_143 | ATCTCAGGTAACTTGATTCACAAAG<br>(SEQ ID NO: 296) | OBD159_141_143 | -0.001918388 |
| 73 | OBD159_147 | CAGGTATTGCCAGCCACAGCGTTTGA<br>(SEQ ID NO: 298) | OBD159_145_147 | -0.003019215 |
| 74 | OBD159_147 | CAGGTATTGCCAGCCACAGCGTTTGA<br>(SEQ ID NO: 298) | OBD159_145_147 | -0.003019215 |
| 75 | OBD159_151 | GACTCAAACAGTAAAATAGGGCACCA<br>(SEQ ID NO: 300) | OBD159_149_151 | -0.003218412 |
| 76 | OBD159_151 | GACTCAAACAGTAAAATAGGGCACCA<br>(SEQ ID NO: 300) | OBD159_149_151 | -0.003218412 |
| 77 | OBD159_155 | GCAAGTGCTCATCTCTAAACAACAAC<br>(SEQ ID NO: 302) | OBD159_153_155 | -0.000118105 |
| 78 | OBD159_155 | GCAAGTGCTCATCTCTAAACAACAAC<br>(SEQ ID NO: 302) | OBD159_153_155 | -0.000118105 |
| 79 | OBD159_159 | CTCCCTTTCCCAGTTTGAGCCCC (SEQ<br>ID NO: 304) | OBD159_157_159 | -0.00349468 |
| 80 | OBD159_159 | CTCCCTTTCCCAGTTTGAGCCCC (SEQ<br>ID NO: 304) | OBD159_157_159 | -0.00349468 |
| 81 | OBD159_163 | TTTATGAGAGTGTGGACAAAATAGGG<br>(SEQ ID NO: 306) | OBD159_161_163 | -0.000877317 |
| 82 | OBD159_163 | TTTATGAGAGTGTGGACAAAATAGGG<br>(SEQ ID NO: 306) | OBD159_161_163 | -0.000877317 |
| 83 | OBD159_167 | CCCCAACACAAACTGTCCTCAGGC<br>(SEQ ID NO: 308) | OBD159_165_167 | -0.005982598 |
| 84 | OBD159_167 | CCCCAACACAAACTGTCCTCAGGC<br>(SEQ ID NO: 308) | OBD159_165_167 | -0.005982598 |
| 85 | OBD159_171 | GTTTCACTTAGTTCTATTCTGATTT | OBD159_169_171 | -0.000811956 |

TABLE 1.b8-continued

| PCR-Primer2_ID | PCR_Primer2 | Marker | GLMNET |
|---|---|---|---|
| | (SEQ ID NO: 310) | | |
| 86 OBD159_171 | GTTTCACTTAGTTCTATTCTGATTT (SEQ ID NO: 310) | OBD159_169_171 | -0.000811956 |
| 87 OBD159_175 | AGCCTGGGTAACAGAGTGAGACT (SEQ ID NO: 312) | OBD159_173_175 | -0.001474355 |
| 88 OBD159_175 | AGCCTGGGTAACAGAGTGAGACT (SEQ ID NO: 312) | OBD159_173_175 | -0.001474355 |
| 89 OBD159_179 | AGAGTGTTGACTGATGAAGGGCTC (SEQ ID NO: 314) | OBD159_177_179 | -0.002586393 |
| 90 OBD159_179 | AGAGTGTTGACTGATGAAGGGCTC (SEQ ID NO: 314) | OBD159_177_179 | -0.002586393 |
| 91 OBD159_183 | CTAACATTTCTTTTCTCCACAGTA (SEQ ID NO: 316) | OBD159_181_183 | -0.003333301 |
| 92 OBD159_183 | CTAACATTTCTTTTCTCCACAGTA (SEQ ID NO: 316) | OBD159_181_183 | -0.003333301 |
| 93 OBD159_187 | TTTGGCTGGAGCACGGAGTCTGC (SEQ ID NO: 318) | OBD159_185_187 | -0.001801783 |
| 94 OBD159_187 | TTTGGCTGGAGCACGGAGTCTGC (SEQ ID NO: 318) | OBD159_185_187 | -0.001801783 |
| 95 OBD159_191 | CTCCACTTCTACCACCACGAGTA (SEQ ID NO: 320) | OBD159_189_191 | -0.002029191 |
| 96 OBD159_191 | CTCCACTTCTACCACCACGAGTA (SEQ ID NO: 320) | OBD159_189_191 | -0.002029191 |
| 97 OBD159_195 | TTTCTGGAGCATTGTATGTCAACT (SEQ ID NO: 322) | OBD159_193_195 | -0.002251075 |
| 98 OBD159_195 | TTTCTGGAGCATTGTATGTCAACT (SEQ ID NO: 322) | OBD159_193_195 | -0.002251075 |
| 99 OBD159_199 | GATGACTGTTTTCAGAGACAATGGAA (SEQ ID NO: 324) | OBD159_197_199 | -0.001778734 |
| 100 OBD159_199 | GATGACTGTTTTCAGAGACAATGGAA (SEQ ID NO: 324) | OBD159_197_199 | -0.001778734 |
| 101 OBD159_203 | TTTTCCTGTCAGTGAACACCGTG (SEQ ID NO: 326) | OBD159_201_203 | -0.000267413 |
| 102 OBD159_203 | TTTTCCTGTCAGTGAACACCGTG (SEQ ID NO: 326) | OBD159_201_203 | -0.000267413 |
| 103 OBD159_207 | TTGGCATAAAGCAGGGCTCCAGGAAT (SEQ ID NO: 328) | OBD159_205_207 | -0.002392578 |
| 104 OBD159_207 | TTGGCATAAAGCAGGGCTCCAGGAAT (SEQ ID NO: 328) | OBD159_205_207 | -0.002392578 |
| 105 OBD159_211 | GCTTCCTCTGCCCCATCTACAAACAT (SEQ ID NO: 330) | OBD159_209_211 | -0.004107822 |
| 106 OBD159_211 | GCTTCCTCTGCCCCATCTACAAACAT (SEQ ID NO: 330) | OBD159_209_211 | -0.004107822 |
| 107 OBD159_215 | CCTACCCAAATAAGACTCATCCCAAC (SEQ ID NO: 332) | OBD159_213_215 | -0.002783152 |
| 108 OBD159_215 | CCTACCCAAATAAGACTCATCCCAAC (SEQ ID NO: 332) | OBD159_213_215 | -0.002783152 |
| 109 OBD159_219 | TTGCAACTAACCATGAAGAA (SEQ ID NO: 334) | OBD159_217_219 | -0.001155074 |
| 110 OBD159_219 | TTGCAACTAACCATGAAGAA (SEQ ID NO: 334) | OBD159_217_219 | -0.001155074 |

TABLE 1.b8-continued

| PCR-Primer2_ID | PCR_Primer2 | Marker | GLMNET |
|---|---|---|---|
| 111 OBD159_223 | TAGACAGAACAGGCAGGCAGTTGGAC (SEQ ID NO: 336) | OBD159_221_223 | -0.002281455 |
| 112 OBD159_223 | TAGACAGAACAGGCAGGCAGTTGGAC (SEQ ID NO: 336) | OBD159_221_223 | -0.002281455 |

TABLE 1.b9

Gene

53 ANKRD18A; CNTNAP3
54 ANKRD18A; CNTNAP3
55 RP5-972B16.2; RPGR; rs5963409; rs771214648; rs606231180; rs606231181; rs137852551; rs267607019; rs730882261; rs398122960; rs527236108; rs869312185; rs1060501181; rs62635004; rs771039023; rs527236109; rs62640593; rs527236112; rs62640590; rs62640589; rs527236111; rs62640587; rs62642057; rs878853374; rs138018739; rs62650220; rs62638651; rs62650218; rs137852550; rs62638646; rs62638644; rs62638643; rs62638637; rs62638636; rs111631988; rs62638634; rs62638630; rs62638629
56 RP5-972B16.2; RPGR; rs5963409; rs771214648; rs606231180; rs606231181; rs137852551; rs267607019; rs730882261; rs398122960; rs527236108; rs869312185; rs1060501181; rs62635004; rs771039023; rs527236109; rs62640593; rs527236112; rs62640590; rs62640589; rs527236111; rs62640587; rs62642057; rs878853374; rs138018739; rs62650220; rs62638651; rs62650218; rs137852550; rs62638646; rs62638644; rs62638643; rs62638637; rs62638636; rs111631988; rs62638634; rs62638630; rs62638629
57 rs59014890; rs2337901
58 rs59014890; rs2337901
59 LINGO2; rs7851437
60 LINGO2; rs7851437
61 rs2337901; rs11897825
62 rs2337901; rs11897825
63 C3orf56; rs7610266
64 C3orf56; rs7610266
65 rs2337901; rs11897825
66 rs2337901; rs11897825
67 FKTN; FSD1L; SLC44A1
68 FKTN; FSD1L; SLC44A1
69 CTDSPL; PLCD1; VILL; rs7372209
70 CTDSPL; PLCD1; VILL; rs7372209
71 SLITRK5
72 SLITRK5
73 MAP2; rs146432517; rs9288410
74 MAP2; rs146432517; rs9288410
75 rs7529073; rs4342822
76 rs7529073; rs4342822
77 C8orf48
78 C8orf48
79 rs7542939
80 rs7542939
81 FMN2; rs727502861; rs727502860
82 FMN2; rs727502861; rs727502860
83 LSM10; OSCP1
84 LSM10; OSCP1
85 CAPS2; KCNC2
86 CAPS2; KCNC2
87 NIN; rs387907308; rs146291102
88 NIN; rs387907308; rs146291102
89 E2F6; GREB1; rs77294520
90 E2F6; GREB1; rs77294520
91 GAFA3; PGM2
92 GAFA3; PGM2
93 ANKRD18A; CNTNAP3
94 ANKRD18A; CNTNAP3
95 PLS3; rs201386833
96 PLS3; rs201386833
97 RP5-972B16.2; RPGR; rs5963409; rs771214648; rs606231180; rs606231181; rs137852551; rs267607019; rs730882261; rs398122960; rs527236108; rs869312185; rs1060501181; rs62635004; rs771039023; rs527236109; rs62640593; rs527236112; rs62640590; rs62640589; rs527236111; rs62640587; rs62642057; rs878853374; rs138018739; rs62650220; rs62638651; rs62650218; rs137852550; rs62638646; rs62638644; rs62638643; rs62638637; rs62638636; rs111631988; rs62638634; rs62638630; rs62638629
98 RP5-972B16.2; RPGR; rs5963409; rs771214648; rs606231180; rs606231181; rs137852551; rs267607019; rs730882261; rs398122960; rs527236108; rs869312185; rs1060501181; rs62635004; rs771039023; rs527236109; rs62640593; rs527236112; rs62640590; rs62640589; rs527236111; rs62640587; rs62642057; rs878853374; rs138018739; rs62650220; rs62638651; rs62650218; rs137852550; rs62638646; rs62638644; rs62638643; rs62638637; rs62638636; rs111631988; rs62638634; rs62638630; rs62638629
99 TBX18; rs72912698; rs760905589; rs869320679; rs797045022; rs77693245
100 TBX18; rs72912698; rs760905589; rs869320679; rs797045022; rs77693245

TABLE 1.b9-continued

| Gene |
| --- |

| 101 | rs1736020; rs1297265; rs2823286; rs2823288; rs2823310 |
| 102 | rs1736020; rs1297265; rs2823286; rs2823288; rs2823310 |
| 103 | MEGF10; rs794726677; rs387907071; rs387907072; rs199750143; rs794726678; rs989552169 |
| 104 | MEGF10; rs794726677; rs387907071; rs387907072; rs199750143; rs794726678; rs989552169 |
| 105 | rs2745959; rs2745967; rs11578508 |
| 106 | rs2745959; rs2745967; rs11578508 |
| 107 | FOLH1; rs202676; rs368939818; rs61886492; rs770894245; rs747052707; rs202680 |
| 108 | FOLH1; rs202676; rs368939818; rs61886492; rs770894245; rs747052707; rs202680 |
| 109 | rs11116045; rs1545843 |
| 110 | rs11116045; rs1545843 |
| 111 | FARP1; RNF113B |
| 112 | FARP1; RNF113B |

TABLE 1.c1

| | Probe | GeneLocus |
| --- | --- | --- |
| 113 | ORF13_16_10047306_10049395_10119747_10125313_FF | GRIN2A; rs7192557 |
| 114 | ORF13_16_10047306_10049395_10119747_10125313_FF | GRIN2A; rs7192557 |
| 115 | ORF13_19_46459835_46460902_46479838_46481514_RF | PNMAL1; PNMAL2; PPP5D1 |
| 116 | ORF13_19_46459835_46460902_46479838_46481514_RF | PNMAL1; PNMAL2; PPP5D1 |
| 117 | ORF13_21_41872387_41876215_41926859_41930173_RR | C2CD2; PRDM15; ZBTB21; rs451390 |
| 118 | ORF13_21_41872387_41876215_41926859_41930173_RR | C2CD2; PRDM15; ZBTB21; rs451390 |
| 119 | ORF13_22_16921135_16923046_16987493_16991720_FR | GAB4; rs41433045 |
| 120 | ORF13_22_16921135_16923046_16987493_16991720_FR | GAB4; rs41433045 |
| 121 | ORF13_3_65738736_65743505_65758131_65766427_RR | MAGI1; rs11924265 |
| 122 | ORF13_3_65738736_65743505_65758131_65766427_RR | MAGI1; rs11924265 |
| 123 | ORF13_3_65738736_65743505_65827279_65831993_RR | MAGI1; rs7633294; rs11924265; rs1909492; rs145965284 |
| 124 | ORF13_3_65738736_65743505_65827279_65831993_RR | MAGI1; rs7633294; rs11924265; rs1909492; rs145965284 |
| 125 | ORF13_7_79409384_79415984_79434265_79448888_FF | MAGI2; rs1135402912 |
| 126 | ORF13_7_79409384_79415984_79434265_79448888_FF | MAGI2; rs1135402912 |
| 127 | ORF13_8_10137237_10138418_10247633_10250634_RR | MSRA; rs7001567; rs10107815; rs73191547; rs17749155; rs2975735 |
| 128 | ORF13_8_10137237_10138418_10247633_10250634_RR | MSRA; rs7001567; rs10107815; rs73191547; rs17749155; rs2975735 |
| 129 | ORF130_3_16438382_16444965_16496760_16499694_FR | RFTN1; rs3856834 |
| 130 | ORF130_3_16438382_16444965_16496760_16499694_FR | RFTN1; rs3856834 |
| 131 | ORF131_13_36625595_36628054_36670823_36673255_FR | SERTM1; rs11619726 |
| 132 | ORF131_13_36625595_36628054_36670823_36673255_FR | SERTM1; rs11619726 |
| 133 | ORF132_X_38848295_38850360_38907082_38913455_RR | MID1IP1; rs199860 |
| 134 | ORF132_X_38848295_38850360_38907082_38913455_RR | MID1IP1; rs199860 |
| 135 | ORF133_14_68255587_68260022_68325745_68327713_FF | RAD51B; rs1570106; rs17105278; rs4902562; rs3784099; rs2208397; rs911263; rs2104047; rs1950897; rs11158728; rs927220; rs61985136; rs8017304; rs1956529; rs4902566 |
| 136 | ORF133_14_68255587_68260022_68325745_68327713_FF | RAD51B; rs1570106; rs17105278; rs4902562; rs3784099; rs2208397; rs911263; rs2104047; rs1950897; rs11158728; rs927220; rs61985136; rs8017304; rs1956529; rs4902566 |
| 137 | ORF133_5_127388766_127390678_127434266_127436041_FR | MEGF10; rs387907071; rs143954261; rs387907073; rs794726679; rs1057518682; rs794726677 |
| 138 | ORF133_5_127388766_127390678_127434266_127436041_FR | MEGF10; rs387907071; rs143954261; rs387907073; rs794726679; rs1057518682; rs794726677 |
| 139 | ORF134_21_30984126_30988102_30998437_31002269_RF | KRTAP19-8; rs8134605 |
| 140 | ORF134_21_30984126_30988102_30998437_31002269_RF | KRTAP19-8; rs8134605 |
| 141 | ORF135_14_78345645_78349226_78398012_78400321_RF | NRXN3; rs11624704 |
| 142 | ORF135_14_78345645_78349226_78398012_78400321_RF | NRXN3; rs11624704 |
| 143 | ORF135_6_84752549_84755954_84775145_84786636_FR | TBX18; rs869320679; rs797045022; rs77693245 |
| 144 | ORF135_6_84752549_84755954_84775145_84786636_FR | TBX18; rs869320679; rs797045022; rs77693245 |
| 145 | ORF135_8_3431982_3435558_3460548_3464200_RF | CSMD1; rs2938236; rs17066135 |
| 146 | ORF135_8_3431982_3435558_3460548_3464200_RF | CSMD1; rs2938236; rs17066135 |
| 147 | ORF136_11_33584612_33595244_33612657_33615678_FF | KIAA1549L; rs4755718; rs2076625 |
| 148 | ORF136_11_33584612_33595244_33612657_33615678_FF | KIAA1549L; rs4755718; rs2076625 |
| 149 | ORF136_16_23139410_23143862_23210381_23212701_RR | SCNN1G; USP31; rs137853342; rs5736 |
| 150 | ORF136_16_23139410_23143862_23210381_23212701_RR | SCNN1G; USP31; rs137853342; rs5736 |
| 151 | ORF136_3_65835051_65839403_65852931_65856153_FF | MAGI1; rs145965284 |
| 152 | ORF136_3_65835051_65839403_65852931_65856153_FF | MAGI1; rs145965284 |
| 153 | ORF138_11_84067130_84068735_84120868_84126600_FR | DLG2; rs790356 |
| 154 | ORF138_11_84067130_84068735_84120868_84126600_FR | DLG2; rs790356 |
| 155 | ORF139_2_38148629_38155476_38206549_38210637_FR | ATL2; CYP1B1 |
| 156 | ORF139_2_38148629_38155476_38206549_38210637_FR | ATL2; CYP1B1 |

TABLE 1.c1-continued

| | Probe | GeneLocus |
|---|---|---|
| 157 | ORF139_3_43868341_43870688_43889253_43893962_RR | rs6441806; rs75594032 |
| 158 | ORF139_3_43868341_43870688_43889253_43893962_RR | rs6441806; rs75594032 |
| 159 | ORF139_X_103107164_103111839_103149176_103158530_FF | BEX4; NXF3 |
| 160 | ORF139_X_103107164_103111839_103149176_103158530_FF | BEX4; NXF3 |
| 161 | ORF14_1_36409666_36411937_36433268_36434547_RR | LSM10; OSCP1 |
| 162 | ORF14_1_36409666_36411937_36433268_36434547_RR | LSM10; OSCP1 |
| 163 | ORF14_11_49143461_49148959_49200052_49204610_FF | FOLH1; rs202676; rs368939818; rs61886492; rs770894245; rs747052707; rs202680 |
| 164 | ORF14_11_49143461_49148959_49200052_49204610_FF | FOLH1; rs202676; rs368939818; rs61886492; rs770894245; rs747052707; rs202680 |
| 165 | ORF14_12_13672704_13680228_13739178_13742093_RF | GRIN2B; rs1060499526; rs2192970; rs2284411; rs2268118 |
| 166 | ORF14_12_13672704_13680228_13739178_13742093_RF | GRIN2B; rs1060499526; rs2192970; rs2284411; rs2268118 |
| 167 | ORF14_2_169020149_169021769_169079530_169081990_FR | ABCB11; DHRS9; rs886043986; rs2161037 |
| 168 | ORF14_2_169020149_169021769_169079530_169081990_FR | ABCB11; DHRS9; rs886043986; rs2161037 |
| 169 | ORF14_2_20283807_20286153_20303337_20304942_RF | PUM2; rs111612372 |
| 170 | ORF14_2_20283807_20286153_20303337_20304942_RF | PUM2; rs111612372 |
| 171 | ORF14_2_20303337_20304942_20379482_20381283_FF | PUM2; rs585017 |
| 172 | ORF14_2_20303337_20304942_20379482_20381283_FF | PUM2; rs585017 |
| 173 | ORF14_6_84752549_84755954_84775145_84786636_FR | TBX18; rs869320679; rs797045022; rs77693245 |
| 174 | ORF14_6_84752549_84755954_84775145_84786636_FR | TBX18; rs869320679; rs797045022; rs77693245 |
| 175 | ORF14_8_52230322_52233827_52248401_52253166_FF | ST18; rs2360806 |
| 176 | ORF14_8_52230322_52233827_52248401_52253166_FF | ST18; rs2360806 |
| 177 | ORF14_8_65560550_65562514_65658401_65661888_FR | ARMC1; MTFR1; rs6991838 |
| 178 | ORF14_8_65560550_65562514_65658401_65661888_FR | ARMC1; MTFR1; rs6991838 |
| 179 | ORF14_9_38648333_38653476_38681931_38686861_RF | ANKRD18A; CNTNAP3 |
| 180 | ORF14_9_38648333_38653476_38681931_38686861_RF | ANKRD18A; CNTNAP3 |
| 181 | ORF140_7_28717278_28719857_28731416_28736388_RR | CREB5; rs56388170 |
| 182 | ORF140_7_28717278_28719857_28731416_28736388_RR | CREB5; rs56388170 |
| 183 | ORF140_7_36976432_36980351_37039732_37049390_RR | ELMO1; rs6942726; rs17170851 |
| 184 | ORF140_7_36976432_36980351_37039732_37049390_RR | ELMO1; rs6942726; rs17170851 |
| 185 | ORF141_2_77514867_77519288_77576705_77580735_RF | LRRTM4; rs61354037 |
| 186 | ORF141_2_77514867_77519288_77576705_77580735_RF | LRRTM4; rs61354037 |
| 187 | ORF142_1_55502863_55511336_55533743_55538240_RR | rs1998013; rs10888935 |
| 188 | ORF142_1_55502863_55511336_55533743_55538240_RR | rs1998013; rs10888935 |
| 189 | ORF142_2_195535991_195542111_195583610_195589061_RF | DNAH7; SLC39A10 |
| 190 | ORF142_2_195535991_195542111_195583610_195589061_RF | DNAH7; SLC39A10 |
| 191 | ORF144_9_33273553_33275175_33317596_33319558_RR | BAG1; CHMP5; NFX1 |
| 192 | ORF144_9_33273553_33275175_33317596_33319558_RR | BAG1; CHMP5; NFX1 |
| 193 | ORF145_2_42093750_42101196_42140119_42144540_RF | EML4; rs17029233 |
| 194 | ORF145_2_42093750_42101196_42140119_42144540_RF | EML4; rs17029233 |
| 195 | ORF145_7_45364155_45370311_45421686_45426816_FR | ADCY1; rs1294908 |
| 196 | ORF145_7_45364155_45370311_45421686_45426816_FR | ADCY1; rs1294908 |
| 197 | ORF147_15_96308452_96311035_96328347_96331473_FR | NR2F2; rs587777373; rs2398180 |
| 198 | ORF147_15_96308452_96311035_96328347_96331473_FR | NR2F2; rs587777373; rs2398180 |
| 199 | ORF148_10_22661441_22663284_22705207_22709478_FF | PIP4K2A; rs1409395; rs370356098 |
| 200 | ORF148_10_22661441_22663284_22705207_22709478_FF | PIP4K2A; rs1409395; rs370356098 |
| 201 | ORF148_2_198067347_198074546_198099686_198102962_FR | PLCL1; rs7587251; rs6745726; rs1368989; rs12105927; rs7590828; rs1866666; rs1036333; rs2164068; rs1064213; rs11684176 |
| 202 | ORF148_2_198067347_198074546_198099686_198102962_FR | PLCL1; rs7587251; rs6745726; rs1368989; rs12105927; rs7590828; rs1866666; rs1036333; rs2164068; rs1064213; rs11684176 |
| 203 | ORF15_10_76403646_76410014_76480867_76489182_RR | C10orf11; rs10509373; rs11593840 |
| 204 | ORF15_10_76403646_76410014_76480867_76489182_RR | C10orf11; rs10509373; rs11593840 |
| 205 | ORF15_2_66539108_66541258_66592400_66595314_RR | MEIS1; rs10865355; rs11897119; rs2300478; rs2300481 |
| 206 | ORF15_2_66539108_66541258_66592400_66595314_RR | MEIS1; rs10865355; rs11897119; rs2300478; rs2300481 |
| 207 | ORF15_8_10100695_10103743_10173552_10175271_FF | MSRA; rs73191547; rs10087178; rs10107815 |
| 208 | ORF15_8_10100695_10103743_10173552_10175271_FF | MSRA; rs73191547; rs10087178; rs10107815 |
| 209 | ORF15_8_65560550_65562514_65637133_65640837_FR | ARMC1; rs6991838 |
| 210 | ORF15_8_65560550_65562514_65637133_65640837_FR | ARMC1; rs6991838 |
| 211 | ORF151_14_106693397_106698909_106739902_106745380_FF | rs2337406; rs11846409 |
| 212 | ORF151_14_106693397_106698909_106739902_106745380_FF | rs2337406; rs11846409 |

TABLE 1.c2

| | Probe_Count_Total | Probe_Count_Sig | HyperG_Stats |
|---|---|---|---|
| 113 | 105 | 2; 1 | 0.137861813; 0.050084955 |
| 114 | 105 | 2; 1 | 0.137861813; 0.050084955 |
| 115 | 28; 32; 32 | 3; 4; 3; 4; 3; 4 | 0.071800115; 0.02285211; 0.09275567; 0.033810966; 0.09275567; 0.033810966 |

TABLE 1.c2-continued

| | Probe_Count_Total | Probe_Count_Sig | HyperG_Stats |
|---|---|---|---|
| 116 | 28; 32; 32 | 3; 4; 3; 4; 3; 4 | 0.071800115; 0.02285211; 0.09275567; 0.033810966; 0.09275567; 0.033810966 |
| 117 | 42; 25; 43 | 1; 1; 1; 1; 1; 1 | 0.320791853; 0.303213711; 0.375519541; 0.375121431; 0.315614698; 0.297350686 |
| 118 | 42; 25; 43 | 1; 1; 1; 1; 1; 1 | 0.320791853; 0.303213711; 0.375519541; 0.375121431; 0.315614698; 0.297350686 |
| 119 | 19 | 1; 1 | 0.362286681; 0.369026848 |
| 120 | 19 | 1; 1 | 0.362286681; 0.369026848 |
| 121 | 55 | 5; 5 | 0.042810093; 0.05348201 |
| 122 | 55 | 5; 5 | 0.042810093; 0.05348201 |
| 123 | 55 | 5; 5 | 0.042810093; 0.05348201 |
| 124 | 55 | 5; 5 | 0.042810093; 0.05348201 |
| 125 | 18 | 1; 1 | 0.357137933; 0.364965787 |
| 126 | 18 | 1; 1 | 0.357137933; 0.364965787 |
| 127 | 115 | 4; 4 | 0.193790369; 0.18374459 |
| 128 | 115 | 4; 4 | 0.193790369; 0.18374459 |
| 129 | 55 | 2; 3 | 0.274632664; 0.209439509 |
| 130 | 55 | 2; 3 | 0.274632664; 0.209439509 |
| 131 | 29 | 2; 2 | 0.211050406; 0.22548219 |
| 132 | 29 | 2; 2 | 0.211050406; 0.22548219 |
| 133 | 10 | 1; 1 | 0.272678156; 0.285987033 |
| 134 | 10 | 1; 1 | 0.272678156; 0.285987033 |
| 135 | 17 | 3; 2 | 0.023054538; 0.126473611 |
| 136 | 17 | 3; 2 | 0.023054538; 0.126473611 |
| 137 | 26 | 3; 3 | 0.061689421; 0.072111 |
| 138 | 26 | 3; 3 | 0.061689421; 0.072111 |
| 139 | 60 | 2; 2 | 0.268298503; 0.259153243 |
| 140 | 60 | 2; 2 | 0.268298503; 0.259153243 |
| 141 | 41 | 1; 1 | 0.325868449; 0.309016356 |
| 142 | 41 | 1; 1 | 0.325868449; 0.309016356 |
| 143 | 20 | 4; 5 | 0.005899409; 0.001067155 |
| 144 | 20 | 4; 5 | 0.005899409; 0.001067155 |
| 145 | 34 | 1; 1 | 0.357029649; 0.346365974 |
| 146 | 34 | 1; 1 | 0.357029649; 0.346365974 |
| 147 | 65 | 1; 2 | 0.198659276; 0.245566966 |
| 148 | 65 | 1; 2 | 0.198659276; 0.245566966 |
| 149 | 26; 18 | 2; 1; 1; 1 | 0.19032457; 0.373699919; 0.357137933; 0.364965787 |
| 150 | 26; 18 | 2; 1; 1; 1 | 0.19032457; 0.373699919; 0.357137933; 0.364965787 |
| 151 | 55 | 5; 5 | 0.042810093; 0.05348201 |
| 152 | 55 | 5; 5 | 0.042810093; 0.05348201 |
| 153 | 22 | 3; 3 | 0.042821316; 0.050708849 |
| 154 | 22 | 3; 3 | 0.042821316; 0.050708849 |
| 155 | 23; 34 | 4; 3; 4; 3 | 0.009574125; 0.055866229; 0.0324282; 0.117734198 |
| 156 | 23; 34 | 4; 3; 4; 3 | 0.009574125; 0.055866229; 0.0324282; 0.117734198 |
| 157 | NA | NA | NA |
| 158 | NA | NA | NA |
| 159 | 17; 17 | 1; 2; 1; 2 | 0.350975055; 0.126473611; 0.350975055; 0.126473611 |
| 160 | 17; 17 | 1; 2; 1; 2 | 0.350975055; 0.126473611; 0.350975055; 0.126473611 |
| 161 | 124; 112 | 3; 3; 3; 3 | 0.149414204; 0.126913559; 0.17713842; 0.156487188 |
| 162 | 124; 112 | 3; 3; 3; 3 | 0.149414204; 0.126913559; 0.17713842; 0.156487188 |
| 163 | 25 | 3; 4 | 0.05677955; 0.016055763 |
| 164 | 25 | 3; 4 | 0.05677955; 0.016055763 |
| 165 | 60 | 1; 2 | 0.22379944; 0.259153243 |
| 166 | 60 | 1; 2 | 0.22379944; 0.259153243 |
| 167 | 28; 49 | 2; 2; 2; 3 | 0.204457601; 0.219149094; 0.276096976; 0.190339907 |
| 168 | 28; 49 | 2; 2; 2; 3 | 0.204457601; 0.219149094; 0.276096976; 0.190339907 |
| 169 | 54 | 5; 6 | 0.040491239; 0.018151611 |
| 170 | 54 | 5; 6 | 0.040491239; 0.018151611 |
| 171 | 54 | 5; 6 | 0.040491239; 0.018151611 |
| 172 | 54 | 5; 6 | 0.040491239; 0.018151611 |
| 173 | 20 | 4; 5 | 0.005899409; 0.001067155 |
| 174 | 20 | 4; 5 | 0.005899409; 0.001067155 |
| 175 | 78 | 2; 4 | 0.222357541; 0.186212358 |
| 176 | 78 | 2; 4 | 0.222357541; 0.186212358 |
| 177 | 48; 28 | 5; 4; 2; 1 | 0.02780594; 0.092112824; 0.204457601; 0.369266824 |
| 178 | 48; 28 | 5; 4; 2; 1 | 0.02780594; 0.092112824; 0.204457601; 0.369266824 |
| 179 | 21; 8 | 8; 8; 8; 8 | 6.3e−07; 1.12e−06; 5.16e−12; 9.55e−12 |
| 180 | 21; 8 | 8; 8; 8; 8 | 6.3e−07; 1.12e−06; 5.16e−12; 9.55e−12 |
| 181 | 54 | 3; 3 | 0.193670022; 0.206710786 |
| 182 | 54 | 3; 3 | 0.193670022; 0.206710786 |
| 183 | 135 | 4; 2 | 0.167299602; 0.052146884 |
| 184 | 135 | 4; 2 | 0.167299602; 0.052146884 |
| 185 | 9 | 3; 2 | 0.00391071; 0.047199169 |
| 186 | 9 | 3; 2 | 0.00391071; 0.047199169 |
| 187 | NA | NA | NA |
| 188 | NA | NA | NA |
| 189 | 61; 81 | 2; 3; 3; 3 | 0.26657373; 0.222001213; 0.227770757; 0.222648484 |
| 190 | 61; 81 | 2; 3; 3; 3 | 0.26657373; 0.222001213; 0.227770757; 0.222648484 |

TABLE 1.c2-continued

| | Probe_Count_Total | Probe_Count_Sig | HyperG_Stats |
|---|---|---|---|
| 191 | 12; 22; 28 | 4; 1; 5; 1; 5; 1 | 0.000827358; 0.314913912; 0.001196845; 0.375573766; 0.003522831; 0.369266824 |
| 192 | 12; 22; 28 | 4; 1; 5; 1; 5; 1 | 0.000827358; 0.314913912; 0.001196845; 0.375573766; 0.003522831; 0.369266824 |
| 193 | 35 | 1; 1 | 0.353195365; 0.341533433 |
| 194 | 35 | 1; 1 | 0.353195365; 0.341533433 |
| 195 | 30 | 2; 2 | 0.21731878; 0.231426351 |
| 196 | 30 | 2; 2 | 0.21731878; 0.231426351 |
| 197 | 62 | 3; 3 | 0.214894644; 0.223472567 |
| 198 | 62 | 3; 3 | 0.214894644; 0.223472567 |
| 199 | 51 | 1; 1 | 0.272236181; 0.249886334 |
| 200 | 51 | 1; 1 | 0.272236181; 0.249886334 |
| 201 | 27 | 1; 2 | 0.374553651; 0.212429916 |
| 202 | 27 | 1; 2 | 0.374553651; 0.212429916 |
| 203 | 76 | 4; 4 | 0.169506823; 0.182516854 |
| 204 | 76 | 4; 4 | 0.169506823; 0.182516854 |
| 205 | 57 | 4; 2 | 0.110951788; 0.26588291 |
| 206 | 57 | 4; 2 | 0.110951788; 0.26588291 |
| 207 | 115 | 4; 4 | 0.193790369; 0.18374459 |
| 208 | 115 | 4; 4 | 0.193790369; 0.18374459 |
| 209 | 48 | 5; 4 | 0.02780594; 0.092112824 |
| 210 | 48 | 5; 4 | 0.02780594; 0.092112824 |
| 211 | NA | NA | NA |
| 212 | NA | NA | NA |

TABLE 1.c3

TABLE 1.c3-continued

| | FDR_HyperG | Percent_Sig | logFC | AveExpr |
|---|---|---|---|---|
| 113 | 0.375519541; 0.376115439 | 1.9; 0.95 | 0.642054929 | 0.642054929 |
| 114 | 0.375519541; 0.376115439 | 1.9; 0.95 | 0.534888101 | 0.534888101 |
| 115 | 0.375519541; 0.376115439; 0.375519541; 0.376115439; 0.375519541; 0.376115439 | 10.71; 14.29; 9.38; 12.5; 9.38; 12.5 | 0.559389203 | 0.559389203 |
| 116 | 0.375519541; 0.376115439; 0.375519541; 0.376115439; 0.375519541; 0.376115439 | 10.71; 14.29; 9.38; 12.5; 9.38; 12.5 | 0.527003029 | 0.527003029 |
| 117 | 0.375519541; 0.376115439; 0.375519541; 0.376115439; 0.375519541; 0.376115439 | 2.38; 2.38; 4; 4; 2.33; 2.33 | 0.777909524 | 0.777909524 |
| 118 | 0.375519541; 0.376115439; 0.375519541; 0.376115439; 0.375519541; 0.376115439 | 2.38; 2.38; 4; 4; 2.33; 2.33 | 0.685362008 | 0.685362008 |
| 119 | 0.375519541; 0.376115439 | 5.26; 5.26 | 0.69171806 | 0.69171806 |
| 120 | 0.375519541; 0.376115439 | 5.26; 5.26 | 0.674817566 | 0.674817566 |
| 121 | 0.375519541; 0.376115439 | 9.09; 9.09 | 0.833849291 | 0.833849291 |
| 122 | 0.375519541; 0.376115439 | 9.09; 9.09 | 0.695864718 | 0.695864718 |
| 123 | 0.375519541; 0.376115439 | 9.09; 9.09 | 0.608567925 | 0.608567925 |
| 124 | 0.375519541; 0.376115439 | 9.09; 9.09 | 0.574949497 | 0.574949497 |
| 125 | 0.375519541; 0.376115439 | 5.56; 5.56 | 0.639632985 | 0.639632985 |
| 126 | 0.375519541; 0.376115439 | 5.56; 5.56 | 0.536103928 | 0.536103928 |
| 127 | 0.375519541; 0.376115439 | 3.48; 3.48 | 0.525096445 | 0.525096445 |
| 128 | 0.375519541; 0.376115439 | 3.48; 3.48 | 0.501604871 | 0.501604871 |
| 129 | 0.375519541; 0.376115439 | 3.64; 5.45 | 0.629919082 | 0.629919082 |
| 130 | 0.375519541; 0.376115439 | 3.64; 5.45 | 0.546528148 | 0.546528148 |
| 131 | 0.375519541; 0.376115439 | 6.9; 6.9 | 0.611119135 | 0.611119135 |
| 132 | 0.375519541; 0.376115439 | 6.9; 6.9 | 0.590770741 | 0.590770741 |
| 133 | 0.375519541; 0.376115439 | 10; 10 | 0.834668158 | 0.834668158 |
| 134 | 0.375519541; 0.376115439 | 10; 10 | 0.631440161 | 0.631440161 |
| 135 | 0.375519541; 0.376115439 | 17.65; 11.76 | 0.680155782 | 0.680155782 |
| 136 | 0.375519541; 0.376115439 | 17.65; 11.76 | 0.664622124 | 0.664622124 |
| 137 | 0.375519541; 0.376115439 | 11.54; 11.54 | 0.607866815 | 0.607866815 |
| 138 | 0.375519541; 0.376115439 | 11.54; 11.54 | 0.552626553 | 0.552626553 |
| 139 | 0.375519541; 0.376115439 | 3.33; 3.33 | 0.669529858 | 0.669529858 |
| 140 | 0.375519541; 0.376115439 | 3.33; 3.33 | 0.665404676 | 0.665404676 |
| 141 | 0.375519541; 0.376115439 | 2.44; 2.44 | 0.592000703 | 0.592000703 |
| 142 | 0.375519541; 0.376115439 | 2.44; 2.44 | 0.574160237 | 0.574160237 |
| 143 | 0.242080288; 0.077749847 | 20; 25 | 0.635545627 | 0.635545627 |
| 144 | 0.242080288; 0.077749847 | 20; 25 | 0.565387572 | 0.565387572 |
| 145 | 0.375519541; 0.376115439 | 2.94; 2.94 | 0.570456105 | 0.570456105 |
| 146 | 0.375519541; 0.376115439 | 2.94; 2.94 | 0.535588266 | 0.535588266 |
| 147 | 0.375519541; 0.376115439 | 1.54; 3.08 | 0.621664701 | 0.621664701 |
| 148 | 0.375519541; 0.376115439 | 1.54; 3.08 | 0.567979364 | 0.567979364 |
| 149 | 0.375519541; 0.376115439; 0.375519541; 0.376115439 | 7.69; 3.85; 5.56; 5.56 | 0.786058889 | 0.786058889 |
| 150 | 0.375519541; 0.376115439; 0.375519541; 0.376115439 | 7.69; 3.85; 5.56; 5.56 | 0.664874819 | 0.664874819 |
| 151 | 0.375519541; 0.376115439 | 9.09; 9.09 | 0.913306418 | 0.913306418 |
| 152 | 0.375519541; 0.376115439 | 9.09; 9.09 | 0.85049037 | 0.85049037 |
| 153 | 0.375519541; 0.376115439 | 13.64; 13.64 | 0.89651913 | 0.89651913 |
| 154 | 0.375519541; 0.376115439 | 13.64; 13.64 | 0.797428847 | 0.797428847 |
| 155 | 0.357661967; 0.376115439; 0.375519541; 0.376115439 | 17.39; 13.04; 11.76; 8.82 | 0.709322488 | 0.709322488 |
| 156 | 0.357661967; 0.376115439; 0.375519541; 0.376115439 | 17.39; 13.04; 11.76; 8.82 | 0.689453202 | 0.689453202 |
| 157 | NA | NA | 0.8399913 | 0.8399913 |
| 158 | NA | NA | 0.71642198 | 0.71642198 |
| 159 | 0.375519541; 0.376115439; 0.375519541; 0.376115439 | 5.88; 11.76; 5.88; 11.76 | 1.020404508 | 1.020404508 |
| 160 | 0.375519541; 0.376115439; 0.375519541; 0.376115439 | 5.88; 11.76; 5.88; 11.76 | 0.96486656 | 0.96486656 |
| 161 | 0.375519541; 0.376115439; 0.375519541; 0.376115439 | 2.42; 2.42; 2.68; 2.68 | 0.600126118 | 0.600126118 |
| 162 | 0.375519541; 0.376115439; 0.375519541; 0.376115439 | 2.42; 2.42; 2.68; 2.68 | 0.587561129 | 0.587561129 |
| 163 | 0.375519541; 0.376115439 | 12; 16 | 0.752070326 | 0.752070326 |
| 164 | 0.375519541; 0.376115439 | 12; 16 | 0.646095977 | 0.646095977 |
| 165 | 0.375519541; 0.376115439 | 1.67; 3.33 | 0.772231914 | 0.772231914 |
| 166 | 0.375519541; 0.376115439 | 1.67; 3.33 | 0.756505991 | 0.756505991 |
| 167 | 0.375519541; 0.376115439; 0.375519541; 0.376115439 | 7.14; 7.14; 4.08; 6.12 | 0.707732194 | 0.707732194 |
| 168 | 0.375519541; 0.376115439; 0.375519541; 0.376115439 | 7.14; 7.14; 4.08; 6.12 | 0.647895485 | 0.647895485 |
| 169 | 0.375519541; 0.376115439 | 9.26; 11.11 | 0.634884917 | 0.634884917 |
| 170 | 0.375519541; 0.376115439 | 9.26; 11.11 | 0.537608783 | 0.537608783 |

TABLE 1.c3-continued

| | FDR_HyperG | Percent_Sig | logFC | AveExpr |
|---|---|---|---|---|
| 171 | 0.375519541; 0.376115439 | 9.26; 11.11 | 0.873814619 | 0.873814619 |
| 172 | 0.375519541; 0.376115439 | 9.26; 11.11 | 0.66582529 | 0.66582529 |
| 173 | 0.242080288; 0.077749847 | 20; 25 | 0.592740002 | 0.592740002 |
| 174 | 0.242080288; 0.077749847 | 20; 25 | 0.567930462 | 0.567930462 |
| 175 | 0.375519541; 0.376115439 | 2.56; 5.13 | 0.650656625 | 0.650656625 |
| 176 | 0.375519541; 0.376115439 | 2.56; 5.13 | 0.57605457 | 0.57605457 |
| 177 | 0.375519541; 0.376115439; 0.375519541; 0.376115439 | 10.42; 8.33; 7.14; 3.57 | 0.882684402 | 0.882684402 |
| 178 | 0.375519541; 0.376115439; 0.375519541; 0.376115439 | 10.42; 8.33; 7.14; 3.57 | 0.78560934 | 0.78560934 |
| 179 | 0.000109745; 0.00028483; 1.35e−09; 4.87e−09 | 38.1; 38.1; 100; 100 | 0.56533113 | 0.56533113 |
| 180 | 0.000109745; 0.00028483; 1.35e−09; 4.87e−09 | 38.1; 38.1; 100; 100 | 0.493648488 | 0.493648488 |
| 181 | 0.375519541; 0.376115439 | 5.56; 5.56 | 0.899280884 | 0.899280884 |
| 182 | 0.375519541; 0.376115439 | 5.56; 5.56 | 0.754589946 | 0.754589946 |
| 183 | 0.375519541; 0.376115439 | 2.96; 1.48 | 0.54191602 | 0.54191602 |
| 184 | 0.375519541; 0.376115439 | 2.96; 1.48 | 0.536557556 | 0.536557556 |
| 185 | 0.185936467; 0.376115439 | 33.33; 22.22 | 0.528816654 | 0.528816654 |
| 186 | 0.185936467; 0.376115439 | 33.33; 22.22 | 0.510412189 | 0.510412189 |
| 187 | NA | NA | 0.570106196 | 0.570106196 |
| 188 | NA | NA | 0.547188195 | 0.547188195 |
| 189 | 0.375519541; 0.376115439; 0.375519541; 0.376115439 | 3.28; 4.92; 3.7; 3.7 | 0.925148196 | 0.925148196 |
| 190 | 0.375519541; 0.376115439; 0.375519541; 0.376115439 | 3.28; 4.92; 3.7; 3.7 | 0.860859073 | 0.860859073 |
| 191 | 0.069549998; 0.376115439; 0.069549998; 0.376115439; 0.184244052; 0.376115439 | 33.33; 8.33; 22.73; 4.55; 17.86; 3.57 | 0.830272909 | 0.830272909 |
| 192 | 0.069549998; 0.376115439; 0.069549998; 0.376115439; 0.184244052; 0.376115439 | 33.33; 8.33; 22.73; 4.55; 17.86; 3.57 | 0.605028673 | 0.605028673 |
| 193 | 0.375519541; 0.376115439 | 2.86; 2.86 | 0.629699885 | 0.629699885 |
| 194 | 0.375519541; 0.376115439 | 2.86; 2.86 | 0.608805138 | 0.608805138 |
| 195 | 0.375519541; 0.376115439 | 6.67; 6.67 | 0.688184104 | 0.688184104 |
| 196 | 0.375519541; 0.376115439 | 6.67; 6.67 | 0.631925311 | 0.631925311 |
| 197 | 0.375519541; 0.376115439 | 4.84; 4.84 | 0.66816546 | 0.66816546 |
| 198 | 0.375519541; 0.376115439 | 4.84; 4.84 | 0.496321797 | 0.496321797 |
| 199 | 0.375519541; 0.376115439 | 1.96; 1.96 | 0.559048166 | 0.559048166 |
| 200 | 0.375519541; 0.376115439 | 1.96; 1.96 | 0.546506729 | 0.546506729 |
| 201 | 0.375519541; 0.376115439 | 3.7; 7.41 | 0.660605853 | 0.660605853 |
| 202 | 0.375519541; 0.376115439 | 3.7; 7.41 | 0.620982224 | 0.620982224 |
| 203 | 0.375519541; 0.376115439 | 5.26; 5.26 | 0.548392035 | 0.548392035 |
| 204 | 0.375519541; 0.376115439 | 5.26; 5.26 | 0.544462095 | 0.544462095 |
| 205 | 0.375519541; 0.376115439 | 7.02; 3.51 | 0.633583316 | 0.633583316 |
| 206 | 0.375519541; 0.376115439 | 7.02; 3.51 | 0.527645503 | 0.527645503 |
| 207 | 0.375519541; 0.376115439 | 3.48; 3.48 | 0.5396147 | 0.5396147 |
| 208 | 0.375519541; 0.376115439 | 3.48; 3.48 | 0.532813708 | 0.532813708 |
| 209 | 0.375519541; 0.376115439 | 10.42; 8.33 | 0.694623516 | 0.694623516 |
| 210 | 0.375519541; 0.376115439 | 10.42; 8.33 | 0.669053043 | 0.669053043 |
| 211 | NA | NA | 0.677090319 | 0.677090319 |
| 212 | NA | NA | 0.525571424 | 0.525571424 |

1.c4

| | T | P.Value | adj.P.Val | B | FC | FC_1 | LS |
|---|---|---|---|---|---|---|---|
| 113 | 12.29657599 | 0.0000000389 | 0.0000112 | 9.28555547 | 1.560550375 | 1.560550375 | 1 |
| 114 | 9.863570244 | 0.000000421 | 0.0000233 | 6.888532755 | 1.448829775 | 1.448829775 | 1 |
| 115 | 8.570462938 | 0.00000186 | 0.000059 | 5.366520046 | 1.473645185 | 1.473645185 | 1 |
| 116 | 7.239748622 | 0.0000106 | 0.000327829 | 3.648069676 | 1.440932774 | 1.440932774 | 1 |
| 117 | 12.23174867 | 0.0000000397 | 0.00000589 | 9.265915789 | 1.714644539 | 1.714644539 | 1 |
| 118 | 8.825906239 | 0.00000141 | 0.0000917 | 5.705820315 | 1.608105445 | 1.608105445 | 1 |
| 119 | 7.339515775 | 0.0000926 | 0.000301666 | 3.786888778 | 1.615205871 | 1.615205871 | 1 |
| 120 | 8.215028312 | 0.00000289 | 0.0000778 | 4.915625384 | 1.59639489 | 1.59639489 | 1 |
| 121 | 19.14681066 | 0.000000000252 | 0.00000103 | 13.97183644 | 1.782434783 | 1.782434783 | 1 |
| 122 | 14.54846247 | 0.00000000561 | 0.00000218 | 11.18765775 | 1.619855045 | 1.619855045 | 1 |
| 123 | 11.04549051 | 0.000000127 | 0.0000213 | 8.119748088 | 1.524744937 | 1.524744937 | 1 |
| 124 | 15.11740631 | 0.00000000362 | 0.00000171 | 11.60988606 | 1.489625316 | 1.489625316 | 1 |
| 125 | 7.756918889 | 0.00000532 | 0.000211946 | 4.353501606 | 1.557932778 | 1.557932778 | 1 |
| 126 | 8.756135369 | 0.00000149 | 0.0005015 | 5.596232128 | 1.450051287 | 1.450051287 | 1 |
| 127 | 18.04698486 | 0.000000000499 | 0.00000152 | 13.3693963 | 1.439029777 | 1.439029777 | 1 |
| 128 | 11.23507651 | 0.000000102 | 0.00000993 | 8.323155136 | 1.415787626 | 1.415787626 | 1 |
| 129 | 16.15349133 | 0.00000000170 | 0.00000121 | 12.33518156 | 1.547478196 | 1.547478196 | 1 |
| 130 | 12.83197859 | 0.000000242 | 0.00000874 | 9.748081285 | 1.460566603 | 1.460566603 | 1 |
| 131 | 13.87996531 | 0.00000001 | 0.0000055 | 10.59694422 | 1.527443626 | 1.527443626 | 1 |
| 132 | 11.16934802 | 0.000000109 | 0.0000103 | 8.258187013 | 1.506051121 | 1.506051121 | 1 |
| 133 | 15.50546579 | 0.00000000285 | 0.00000294 | 11.78233016 | 1.783446771 | 1.783446771 | 1 |
| 134 | 7.456443365 | 0.00000774 | 0.000146321 | 3.901820902 | 1.549110612 | 1.549110612 | 1 |
| 135 | 9.171197371 | 0.000000915 | 0.0000379 | 6.095816878 | 1.602312763 | 1.602312763 | 1 |
| 136 | 15.72367178 | 0.00000000243 | 0.00000276 | 11.93052546 | 1.585153029 | 1.585153029 | 1 |
| 137 | 8.352727895 | 0.00000244 | 0.0000699 | 5.092073514 | 1.524004133 | 1.524004133 | 1 |
| 138 | 8.826468071 | 0.00000141 | 0.0000917 | 5.706495712 | 1.46675362 | 1.46675362 | 1 |
| 139 | 9.778292783 | 0.000000476 | 0.0000471 | 6.801498437 | 1.590554557 | 1.590554557 | 1 |
| 140 | 16.33513633 | 0.00000000149 | 0.00000114 | 12.45688849 | 1.586013087 | 1.586013087 | 1 |
| 141 | 6.305428984 | 0.0000401 | 0.000788065 | 2.28193028 | 1.507335644 | 1.507335644 | 1 |
| 142 | 12.84449383 | 0.000000023 | 0.00000441 | 9.808591378 | 1.488810605 | 1.488810605 | 1 |
| 143 | 13.38587721 | 0.0000000151 | 0.00000688 | 10.20566573 | 1.553525182 | 1.553525182 | 1 |
| 144 | 12.59163536 | 0.0000000287 | 0.000005 | 9.587875271 | 1.479784992 | 1.479784992 | 1 |
| 145 | 9.442845356 | 0.000000671 | 0.0000311 | 6.412723986 | 1.484992974 | 1.484992974 | 1 |
| 146 | 7.596849376 | 0.00000656 | 0.000239887 | 4.138885561 | 1.449533088 | 1.449533088 | 1 |
| 147 | 11.62558761 | 0.0000000725 | 0.0000153 | 8.67583038 | 1.538649579 | 1.538649579 | 1 |
| 148 | 15.26126084 | 0.0000000000325 | 0.00000161 | 11.71387103 | 1.482445805 | 1.482445805 | 1 |
| 149 | 6.105674865 | 0.0000541 | 0.000962931 | 1.973943798 | 1.724357475 | 1.724357475 | 1 |
| 150 | 8.371648256 | 0.00000238 | 0.0000689 | 5.116142152 | 1.585430702 | 1.585430702 | 1 |

1.c4

|  | T | P.Value | adj.P.Val | B | FC | FC_1 | LS |
|---|---|---|---|---|---|---|---|
| 151 | 15.88124985 | 0.00000000217 | 0.00000259 | 12.03604736 | 1.883356898 | 1.883356898 | 1 |
| 152 | 18.19418346 | 0.000000000429 | 0.000000653 | 13.61809441 | 1.803113697 | 1.803113697 | 1 |
| 153 | 20.04156697 | 0.000000000148 | 0.00000103 | 14.42944596 | 1.86156905 | 1.86156905 | 1 |
| 154 | 12.881791 | 0.0000000222 | 0.00000435 | 9.840773338 | 1.738000921 | 1.738000921 | 1 |
| 155 | 12.3642085 | 0.0000000366 | 0.0000108 | 9.345123175 | 1.635036099 | 1.635036099 | 1 |
| 156 | 9.152158447 | 0.000000935 | 0.0000385 | 6.073312254 | 1.612672181 | 1.612672181 | 1 |
| 157 | 19.10878979 | 0.000000000257 | 0.00000103 | 13.95176635 | 1.790039347 | 1.790039347 | 1 |
| 158 | 10.43275288 | 0.000000229 | 0.0000161 | 7.504665857 | 1.643101929 | 1.643101929 | 1 |
| 159 | 21.00404466 | 0.0000000000807 | 0.00000039 | 15.12202904 | 2.028487635 | 2.028487635 | 1 |
| 160 | 12.79168312 | 0.0000000251 | 0.00000885 | 9.713978326 | 1.951882976 | 1.951882976 | 1 |
| 161 | 21.66770766 | 0.0000000000597 | 0.000000663 | 15.19411522 | 1.515849073 | 1.515849073 | 1 |
| 162 | 13.98057328 | 0.00000000883 | 0.00000269 | 10.74792677 | 1.502704282 | 1.502704282 | 1 |
| 163 | 13.876189 | 0.00000000961 | 0.00000281 | 10.66502031 | 1.684208004 | 1.684208004 | 1 |
| 164 | 11.81234601 | 0.0000000608 | 0.0000138 | 8.849033958 | 1.564927669 | 1.564927669 | 1 |
| 165 | 11.53329799 | 0.0000000792 | 0.0000162 | 8.589212532 | 1.707909954 | 1.707909954 | 1 |
| 166 | 14.31826594 | 0.00000000673 | 0.00000237 | 11.01167664 | 1.689394186 | 1.689394186 | 1 |
| 167 | 11.24102356 | 0.000000105 | 0.000019 | 8.31031525 | 1.633234778 | 1.633234778 | 1 |
| 168 | 14.54104319 | 0.00000000565 | 0.00000218 | 11.18203304 | 1.566880858 | 1.566880858 | 1 |
| 169 | 19.3999006 | 0.000000000204 | 0.000000503 | 14.29706452 | 1.552813878 | 1.552813878 | 1 |
| 170 | 10.07154199 | 0.000000347 | 0.000039 | 7.12001582 | 1.451564605 | 1.451564605 | 1 |
| 171 | 15.60748179 | 0.00000000264 | 0.00000286 | 11.85191731 | 1.832501804 | 1.832501804 | 1 |
| 172 | 10.83942215 | 0.000000151 | 0.0000126 | 7.926551142 | 1.586475553 | 1.586475553 | 1 |
| 173 | 11.54164794 | 0.0000000757 | 0.00000841 | 8.621484254 | 1.508108266 | 1.508108266 | 1 |
| 174 | 9.732052458 | 0.000000501 | 0.0000487 | 6.750493527 | 1.482395556 | 1.482395556 | 1 |
| 175 | 9.854433288 | 0.000000438 | 0.0000448 | 6.885017151 | 1.569882546 | 1.569882546 | 1 |
| 176 | 9.330647052 | 0.000000762 | 0.0000339 | 6.282774663 | 1.490766774 | 1.490766774 | 1 |
| 177 | 12.25442736 | 0.0000000405 | 0.0000114 | 9.24826214 | 1.843802848 | 1.843802848 | 1 |
| 178 | 12.90483498 | 0.0000000218 | 0.00000431 | 9.860609412 | 1.723820242 | 1.723820242 | 1 |
| 179 | 6.227858807 | 0.000045 | 0.000850219 | 2.163006432 | 1.4797271 | 1.4797271 | 1 |
| 180 | 7.44435462 | 0.00000786 | 0.000147933 | 3.885074196 | 1.408001126 | 1.408001126 | 1 |
| 181 | 13.07374694 | 0.0000000196 | 0.00000788 | 9.950348451 | 1.865136068 | 1.865136068 | 1 |
| 182 | 19.91676727 | 0.000000000150 | 0.000000464 | 14.57215105 | 1.687151988 | 1.687151988 | 1 |
| 183 | 10.98867694 | 0.000000135 | 0.0000221 | 8.063765262 | 1.455904797 | 1.455904797 | 1 |
| 184 | 16.12532926 | 0.00000000173 | 0.00000121 | 12.31617161 | 1.4505073 | 1.4505073 | 1 |
| 185 | 9.761017839 | 0.000000471 | 0.000025 | 6.774194723 | 1.442745323 | 1.442745323 | 1 |
| 186 | 8.292905428 | 0.00000269 | 0.000138197 | 5.048700551 | 1.424457116 | 1.424457116 | 1 |
| 187 | 14.16188606 | 0.00000000763 | 0.00000252 | 10.89037664 | 1.48463285 | 1.48463285 | 1 |
| 188 | 10.9669012 | 0.000000138 | 0.0000224 | 8.042234039 | 1.46123498 | 1.46123498 | 1 |
| 189 | 12.41082654 | 0.0000000351 | 0.0000105 | 9.385986987 | 1.898879288 | 1.898879288 | 1 |
| 190 | 15.0227439 | 0.00000000389 | 0.00000178 | 11.54085912 | 1.816119422 | 1.816119422 | 1 |
| 191 | 7.831039921 | 0.00000472 | 0.000106638 | 4.411447921 | 1.778021672 | 1.778021672 | 1 |
| 192 | 6.383716681 | 0.0000357 | 0.000729587 | 2.40108624 | 1.521008982 | 1.521008982 | 1 |
| 193 | 14.04269586 | 0.00000000839 | 0.00000263 | 10.796955 | 1.547243096 | 1.547243096 | 1 |
| 194 | 9.786691524 | 0.000000472 | 0.0000468 | 6.810739504 | 1.524995661 | 1.524995661 | 1 |
| 195 | 11.80999999 | 0.0000000609 | 0.0000138 | 8.846875259 | 1.611254183 | 1.611254183 | 1 |
| 196 | 10.87786687 | 0.000000145 | 0.0000123 | 7.965676533 | 1.549631635 | 1.549631635 | 1 |
| 197 | 12.34739858 | 0.0000000372 | 0.0000109 | 9.330349145 | 1.589051035 | 1.589051035 | 1 |
| 198 | 19.10074585 | 0.000000000244 | 0.000000514 | 14.13358838 | 1.410612566 | 1.410612566 | 1 |
| 199 | 11.15023282 | 0.000000111 | 0.0000104 | 8.239225146 | 1.473296873 | 1.473296873 | 1 |
| 200 | 10.17124154 | 0.000000312 | 0.0000369 | 7.226393871 | 1.46054492 | 1.46054492 | 1 |
| 201 | 10.98010134 | 0.000000136 | 0.0000222 | 8.05529085 | 1.580746311 | 1.580746311 | 1 |
| 202 | 17.71105209 | 0.000000000586 | 0.000000747 | 13.330373 | 1.537921882 | 1.537921882 | 1 |
| 203 | 22.07702074 | 0.0000000000450 | 0.00000032 | 15.62922376 | 1.462454799 | 1.462454799 | 1 |
| 204 | 10.42317496 | 0.000000239 | 0.0000316 | 7.490992927 | 1.458476453 | 1.458476453 | 1 |
| 205 | 14.44991956 | 0.00000000607 | 0.00000227 | 11.11269518 | 1.551413559 | 1.551413559 | 1 |
| 206 | 14.9951486 | 0.00000000417 | 0.0000369 | 11.42604699 | 1.441574607 | 1.441574607 | 1 |
| 207 | 12.26156198 | 0.0000000386 | 0.00000581 | 9.292944196 | 1.453584258 | 1.453584258 | 1 |
| 208 | 16.76008538 | 0.0000000117 | 0.0000021 | 12.60248449 | 1.446748058 | 1.446748058 | 1 |
| 209 | 11.64102375 | 0.0000000688 | 0.00000796 | 8.716560039 | 1.618462027 | 1.618462027 | 1 |
| 210 | 8.321741849 | 0.0000026 | 0.000135064 | 5.085106196 | 1.590028961 | 1.590028961 | 1 |
| 211 | 8.075983057 | 0.00000353 | 0.000163981 | 4.771615491 | 1.598911756 | 1.598911756 | 1 |
| 212 | 11.47180426 | 0.0000000809 | 0.00000873 | 8.554190275 | 1.439503627 | 1.439503627 | 1 |

TABLE 1.c5

| | Loop Detected | Probe sequence 60 mer | Probe Location Chr |
|---|---|---|---|
| 113 | mHC | TTTATTGATTTTTTACTATTTTTTTTTTTCGACAATAAATGCAAAAGTTTGAAAAAATC (SEQ ID NO: 338) | 16 |
| 114 | sHC | TTTATTGATTTTTTACTATTTTTTTTTTTCGACAATAAATGCAAAAGTTTGAAAAAATC (SEQ | 16 |

TABLE 1.c5-continued

| Loop Detected | Probe sequence 60 mer | Probe Location Chr |
|---|---|---|
| | ID NO: 338) | |
| 115 sHC | TTTTTAAAGAAGGTTTGTATCATATTTCTCGATATTATTCTATCAGTCCTGCAGTCCTGT (SEQ ID NO: 340) | 19 |
| 116 mHC | TTTTTAAAGAAGGTTTGTATCATATTTCTCGATATTATTCTATCAGTCCTGCAGTCCTGT (SEQ ID NO: 340) | 19 |
| 117 sHC | CAATATTTTCAGAGTCATAATATATACATCGAATAATTTTCACTTTCATCACATTCTGTA (SEQ ID NO: 342) | 21 |
| 118 mHC | CAATATTTTCAGAGTCATAATATATACATCGAATAATTTTCACTTTCATCACATTCTGTA (SEQ ID NO: 342) | 21 |
| 119 mHC | TACCTTTATTTTTGAAGCATATCTTCACTCGAAATTTAATTTAATTTTAATTAGCTTAAA (SEQ ID NO: 344) | 22 |
| 120 sHC | TACCTTTATTTTTGAAGCATATCTTCACTCGAAATTTAATTTAATTTTAATTAGCTTAAA (SEQ ID NO: 344) | 22 |
| 121 mHC | CCTTTCAATGTATTGTTACTGCTACTCATCGAGGAGATAAATCTCCCAGTCCTAGTTGGT (SEQ ID NO: 346) | 3 |
| 122 sHC | CCTTTCAATGTATTGTTACTGCTACTCATCGAGGAGATAAATCTCCCAGTCCTAGTTGGT (SEQ ID NO: 346) | 3 |
| 123 mHC | CCTTTCAATGTATTGTTACTGCTACTCATCGAAAGTTGATGCCAAATTGGGAAGTAAGAC (SEQ ID NO: 348) | 3 |
| 124 sHC | CCTTTCAATGTATTGTTACTGCTACTCATCGAAAGTTGATGCCAAATTGGGAAGTAAGAC (SEQ ID NO: 348) | 3 |
| 125 mHC | AATTGTATATTAGACTAGATTAGACTATTCGAATGTTAAATATGATTATTTGCTTTTTAT (SEQ ID NO: 350) | 7 |
| 126 sHC | AATTGTATATTAGACTAGATTAGACTATTCGAATGTTAAATATGATTATTTGCTTTTTAT (SEQ ID NO: 350) | 7 |
| 127 mHC | AACCAATTTTTAAAATATGCTTTTAAGTCGATTGGATATGAACACTACCTGCTAAGTTA (SEQ ID NO: 352) | 8 |
| 128 sHC | AACCAATTTTTAAAATATGCTTTTAAGTCGATTGGATATGAACACTACCTGCTAAGTTA (SEQ ID NO: 352) | 8 |
| 129 sHC | TTTAGTATTAGAAATGTTTTGGTCTTTATCGAAAGACACGTATGAGAAAGCTAACAGTAG (SEQ ID NO: 354) | 3 |
| 130 mHC | TTTAGTATTAGAAATGTTTTGGTCTTTATCGAAAGACACGTATGAGAAAGCTAACAGTAG (SEQ ID NO: 354) | 3 |
| 131 mHC | GGATCAAACCCTTCATATATACCAATTATCGAAATATGAATCATCTTTGTCCAGTATGGA (SEQ ID NO: 356) | 13 |
| 132 sHC | GGATCAAACCCTTCATATATACCAATTATCGAAATATGAATCATCTTTGTCCAGTATGGA (SEQ ID NO: 356) | 13 |
| 133 mHC | TTTTTTATATCATACTTTTGGTTTTAAATCGATTCCTCTGTAAAATTATAGAATGGACT (SEQ ID NO: 358) | X |
| 134 sHC | TTTTTTATATCATACTTTTGGTTTTAAATCGATTCCTCTGTAAAATTATAGAATGGACT (SEQ ID NO: 358) | X |
| 135 sHC | CACAAAATAACAAATATATAAGATATTTTCGAAGATTAATATCTACTCATAATGGTTAGA (SEQ ID NO: 360) | 14 |
| 136 mHC | CACAAAATAACAAATATATAAGATATTTTCGAAGATTAATATCTACTCATAATGGTTAGA (SEQ ID NO: 360) | 14 |
| 137 sHC | TCATCTTCTATAAAAATCATTTAATTAATCGATTTTTATTGCCAGAAACGACTCTTAAAG (SEQ ID NO: 362) | 5 |
| 138 mHC | TCATCTTCTATAAAAATCATTTAATTAATCGATTTTTATTGCCAGAAACGACTCTTAAAG (SEQ ID NO: 362) | 5 |
| 139 mHC | AATAACAATTCACCAAAATTTTAAACATTCGAATTTTTAAATTTATTTCTGTAAATAAAG (SEQ ID NO: 364) | 21 |

TABLE 1.c5-continued

| | Loop Detected | Probe sequence 60 mer | Probe Location Chr |
|---|---|---|---|
| 140 | sHC | AATAACAATTCACCAAAATTTTAAACATTCGAATTITTAAATTTATTTCTGTAAATAAAG (SEQ ID NO: 364) | 21 |
| 141 | mHC | AAAGATTAGTTTCAAAATTTCTATAAACTCGATGGATATAGCAAACCAATTGGTTTCCCT (SEQ ID NO: 366) | 14 |
| 142 | sHC | AAAGATTAGTTTCAAAATTTCTATAAACTCGATGGATATAGCAAACCAATTGGTTTCCCT (SEQ ID NO: 366) | 14 |
| 143 | mHC | GGTATTTCTTTTATGTATGATATATTCTTCGAGTCGCTCAGAAGCGACCTAAAGAAGGCA (SEQ ID NO: 368) | 6 |
| 144 | sHC | GGTATTTCTITTATGTATGATATATTCTTCGAGTCGCTCAGAAGCGACCTAAAGAAGGCA (SEQ ID NO: 368) | 6 |
| 145 | sHC | ATGCAGTTCATCAACTAGTGTGATGAACTCGAATGTGATCATGTAAGAGATCACTGTGTG (SEQ ID NO: 370) | 8 |
| 146 | mHC | ATGCAGTTCATCAACTAGTGTGATGAACTCGAATGTGATCATGTAAGAGATCACTGTGTG (SEQ ID NO: 370) | 8 |
| 147 | mHC | CTATATTTGCTTCATAATTTTTTCTTTTTCGACATTGAAGTGTATACCAGTCTACTTTTG (SEQ ID NO: 372) | 11 |
| 148 | sHC | CTATATTTGCTTCATAATTTTTTCTTTTTCGACATTGAAGTGTATACCAGTCTACTTTTG (SEQ ID NO: 372) | 11 |
| 149 | mHC | ATCAGTTTATTTTACTTTATTTTTTATTTCGAAAAAATGAAACGATACAGCAACATTGAG (SEQ ID NO: 374) | 16 |
| 150 | sHC | ATCAGTTTATTTTACTTTATTTTTTATTTCGAAAAAATGAAACGATACAGCAACATTGAG (SEQ ID NO: 374) | 16 |
| 151 | mHC | TTATATCATTATTTTATAATGTATTCCTTCGAAATATAAGTTAGTTAAAATTAAACATAA (SEQ ID NO: 376) | 3 |
| 152 | sHC | TTATATCATTATTTTATAATGTATTCCTTCGAAATATAAGTTAGTTAAAATTAAACATAA (SEQ ID NO: 376) | 3 |
| 153 | mHC | CTCATTATACTGAGTTTATTTGTITTATTCGAATAACTATATCCTTACATTCAGTCACTA (SEQ ID NO: 378) | 11 |
| 154 | sHC | CTCATTATACTGAGTTTATTTGTITTATTCGAATAACTATATCCTTACATTCAGTCACTA (SEQ ID NO: 378) | 11 |
| 155 | mHC | TCATAAAATAATAATTAACAAACATACATCGAACATACTAATCTTTTTACCAAGTGTTTG (SEQ ID NO: 380) | 2 |
| 156 | sHC | TCATAAAATAATAATTAACAAACATACATCGAACATACTAATCTTTTTACCAAGTGTTTG (SEQ ID NO: 380) | 2 |
| 157 | mHC | TAGCTGTTTAATTATCAATATATTAATTTCGATAATTTTCTCTCTTCCATTTTCTTTATT (SEQ ID NO: 382) | 3 |
| 158 | sHC | TAGCTGTTTAATTATCAATATATTAATTTCGATAATTTTCTCTCTTCCATTTTCTTTATT (SEQ ID NO: 382) | 3 |
| 159 | sHC | AATATATTTCTAAAATATGTAAATATATTCGATATATGTTTTATGAGTAAAGAAGCAGAT (SEQ ID NO: 384) | X |
| 160 | mHC | AATATATTTCTAAAATATGTAAATATATTCGATATATGTTTTATGAGTAAAGAAGCAGAT (SEQ ID NO: 384) | X |
| 161 | mHC | TGGTAAATTGGAGCAGGTGACCTGGGAGTCGAGGCAGCTGCAGGATTTAAATTGGCTGAG (SEQ ID NO: 188) | 1 |
| 162 | sHC | TGGTAAATTGGAGCAGGTGACCTGGGAGTCGAGGCAGCTGCAGGATTTAAATTGGCTGAG (SEQ ID NO: 188) | 1 |
| 163 | sHC | ATTTTTTTTTATTATTATACTTTTAAGTTCGAACTTCTTTATCTTTGTGGAAAACCCTCC (SEQ ID NO: 388) | 11 |
| 164 | mHC | ATTTTTTTTTATTATTATACTTTTAAGTTCGAACTTCTTTATCTTTGTGGAAAACCCTCC (SEQ ID NO: 388) | 11 |

TABLE 1.c5-continued

| | Loop Detected | Probe sequence 60 mer | Probe Location Chr |
|---|---|---|---|
| 165 | mHC | GTTCTCTGACTTTTATACCTAAGATAATCGATATGAAAATGTTCTATTCTATTATCTCA (SEQ ID NO: 390) | 12 |
| 166 | sHC | GTTCTCTGACTTTTTATACCTAAGATAATCGATATGAAAATGTTCTATTCTATTATCTCA (SEQ ID NO: 390) | 12 |
| 167 | mHC | TATATTTAATTATAATTGTAACACAATGTCGAAGGAAAAATTAGGAAATAATTGTAAGAA (SEQ ID NO: 392) | 2 |
| 168 | sHC | TATATTTAATTATAATTGTAACACAATGTCGAAGGAAAAATTAGGAAATAATTGTAAGAA (SEQ ID NO: 392) | 2 |
| 169 | sHC | TATATGGTACATATTATACATATTTCTATCGAAGAAGAAGGATTAAAAAAACTGGGAGTA (SEQ ID NO: 394) | 2 |
| 170 | mHC | TATATGGTACATATTATACATATTTCTATCGAAGAAGAAGGATTAAAAAAACTGGGAGTA (SEQ ID NO: 394) | 2 |
| 171 | mHC | TATATGGTACATATTATACATATTTCTATCGAGAAATAAACTCATATATTTATGATCTAC (SEQ ID NO: 396) | 2 |
| 172 | sHC | TATATGGTACATATTATACATATTTCTATCGAGAAATAAACTCATATATTTATGATCTAC (SEQ ID NO: 396) | 2 |
| 173 | sHC | GGTATTTCTTTTATGTATGATATATTCTTCGAGTCGCTCAGAAGCGACCTAAAGAAGGCA (SEQ ID NO: 368) | 6 |
| 174 | mHC | GGTATTTCTTTTATGTATGATATATTCTTCGAGTCGCTCAGAAGCGACCTAAAGAAGGCA (SEQ ID NO: 368) | 6 |
| 175 | mHC | GTTTCTTTTTAAAGTAAATTAAATTTAATCGAAGTATGCACTGTAACTTCTATAATCTTA (SEQ ID NO: 400) | 8 |
| 176 | sHC | GTTTCTTTTTAAAGTAAATTAAATTTAATCGAAGTATGCACTGTAACTTCTATAATCTTA (SEQ ID NO: 400) | 8 |
| 177 | mHC | TATCTCTATGTAATAATCACTAAAAGTATCGAGCTACATACTATTATATATTTTCACAGT (SEQ ID NO: 402) | 8 |
| 178 | sHC | TATCTCTATGTAATAATCACTAAAAGTATCGAGCTACATACTATTATATATTTTCACAGT (SEQ ID NO: 402) | 8 |
| 179 | mHC | CCACGGAGGGGTCCTTCTGAACTGCAATTCGAGAGCTGGTCTTGACGAGGTGTGCCTTGC (SEQ ID NO: 404) | 9 |
| 180 | sHC | CCACGGAGGGGTCCTTCTGAACTGCAATTCGAGAGCTGGTCTTGACGAGGTGTGCCTTGC (SEQ ID NO: 404) | 9 |
| 181 | mHC | TATGAAAATATAAAAGAATATAAAGAGTTCGATTATGTGTCTTGAAAACAAGAATTGAGA (SEQ ID NO: 406) | 7 |
| 182 | sHC | TATGAAAATATAAAAGAATATAAAGAGTTCGATTATGTGTCTTGAAAACAAGAATTGAGA (SEQ ID NO: 406) | 7 |
| 183 | mHC | CTAATAATAATTATGCTGTTAAGCTCAATCGACAATAAATACTTAAAATTCACACGGTTT (SEQ ID NO: 408) | 7 |
| 184 | sHC | CTAATAATAATTATGCTGTTAAGCTCAATCGACAATAAATACTTAAAATTCACACGGTTT (SEQ ID NO: 408) | 7 |
| 185 | sHC | TATATATTAAGTTATACAACATGATATTTCGAAGGAAAAAATTGATATACAGAATGAAGC (SEQ ID NO: 410) | 2 |
| 186 | mHC | TATATATTAAGTTATACAACATGATATTTCGAAGGAAAAAATTGATATACAGAATGAAGC (SEQ ID NO: 410) | 2 |
| 187 | sHC | GTTATTATACTGCTAAATAATAAGATCCTCGAGCTTCACTTTTTATATATGTAAAATGGA (SEQ ID NO: 412) | 1 |
| 188 | mHC | GTTATTATACTGCTAAATAATAAGATCCTCGAGCTTCACTTTTTATATATGTAAAATGGA (SEQ ID NO: 412) | 1 |
| 189 | mHC | ATTTTTAATTATTAAAAAATAATGTTTTTCGACTTGTATTACCTCATGTAGTTCTCATAT (SEQ ID NO: 414) | 2 |
| 190 | sHC | ATTTTTAATTATTAAAAAATAATGTTTTTCGACTTGTATTACCTCATGTAGTTCTCATAT (SEQ | 2 |

TABLE 1.c5-continued

| | Loop Detected | Probe sequence 60 mer | Probe Location Chr |
|---|---|---|---|
| | | ID NO: 414) | |
| 191 | sHC | TTTAGGAAAATAAATCTGACCAAAAAATTCGAGGCCGCAGTAAGCTGTGTTCACACCACT (SEQ ID NO: 416) | 9 |
| 192 | mHC | TTTAGGAAAATAAATCTGACCAAAAAATTCGAGGCCGCAGTAAGCTGTGTTCACACCACT (SEQ ID NO: 416) | 9 |
| 193 | sHC | TTTAATCAGTTTCCTTTTTTTTTTTTTTTCGAAAAAAAAAAAAAGCCATTGAAGGGATTT (SEQ ID NO: 418) | 2 |
| 194 | mHC | TTTAATCAGTTTCCTTTTTTTTTTTTTTTCGAAAAAAAAAAAAAGCCATTGAAGGGATTT (SEQ ID NO: 418) | 2 |
| 195 | mHC | TTACTCACTTATTAGTCTATTAAGATTTTCGATTAAGTCTAATTTAGCACTTTCTCTTTT (SEQ ID NO: 420) | 7 |
| 196 | sHC | TTACTCACTTATTAGTCTATTAAGATTTTCGATTAAGTCTAATTTAGCACTTTCTCTTTT (SEQ ID NO: 420) | 7 |
| 197 | mHC | AAATAACTTACATATGGACATGAGTATATCGATATTGTTCCTTCCCATGTTTGTAAAAGG (SEQ ID NO: 422) | 15 |
| 198 | sHC | AAATAACTTACATATGGACATGAGTATATCGATATTGTTCCTTCCCATGTTTGTAAAAGG (SEQ ID NO: 422) | 15 |
| 199 | sHC | TCTGATATATATTTGCTAAGGTAGTAAATCGAAATACAAATTTTGGAATTGAAGGGAATT (SEQ ID NO: 424) | 10 |
| 200 | mHC | TCTGATATATATTTGCTAAGGTAGTAAATCGAAATACAAATTTTGGAATTGAAGGGAATT (SEQ ID NO: 424) | 10 |
| 201 | mHC | GTAAATATTACCATTAAAAACTGAAAAGTCGATTATCTCTTTATGACGTTTATTAGACAA (SEQ ID NO: 426) | 2 |
| 202 | sHC | GTAAATATTACCATTAAAAACTGAAAGTCGATTATCTCTTTATGACGTTTATTAGACAA (SEQ ID NO: 426) | 2 |
| 203 | sHC | ACTCTTCAAAATTATAATTATCAACAATTCGAAGAATACCTTAAAGGTAATCATATGTAT (SEQ ID NO: 428) | 10 |
| 204 | mHC | ACTCTTCAAAATTATAATTATCAACAATTCGAAGAATACCTTAAAGGTAATCATATGTAT (SEQ ID NO: 428) | 10 |
| 205 | sHC | AAGGCAGGTGGATCATAAGGTCAGGAGATCGAAAAAAAAATAAAAAAATAAAAAAATAAA (SEQ ID NO: 430) | 2 |
| 206 | mHC | AAGGCAGGTGGATCATAAGGTCAGGAGATCGAAAAAAAAATAAAAAAATAAAAAAATAAA (SEQ ID NO: 430) | 2 |
| 207 | sHC | TTTAAAATGCTTTAAAATTGTTTAAATATCGATTCTAGAGGAAGTCAAATAAAACAATGG (SEQ ID NO: 432) | 8 |
| 208 | mHC | TTTAAAATGCTTTAAAATTGTTTAAATATCGATTCTAGAGGAAGTCAAATAAAACAATGG (SEQ ID NO: 432) | 8 |
| 209 | sHC | TATCTCTATGTAATAATCACTAAAAGTATCGAGTACATAGCTCTGACATATTTATATGTA (SEQ ID NO: 434) | 8 |
| 210 | mHC | TATCTCTATGTAATAATCACTAAAAGTATCGAGTACATAGCTCTGACATATTTATATGTA (SEQ ID NO: 434) | 8 |
| 211 | mHC | AATACACTACAGCTATATGTCCCTGTCTTCGAAGACAGGGACATATAGCTGTAGTGTATT (SEQ ID NO: 436) | 14 |
| 212 | sHC | AATACACTACAGCTATATGTCCCTGTCTTCGAAGACAGGGACATATAGCTGTAGTGTATT (SEQ ID NO: 436) | 14 |

TABLE 1.c6

| | Probe Location | | | | 4 kb Sequence Location | | | |
|---|---|---|---|---|---|---|---|---|
| | Start1 | End1 | Start2 | End2 | Chr | Start1 | End1 | Start2 | End2 |
| 113 | 10049364 | 10049395 | 10125282 | 10125313 | 16 | 10045394 | 10049395 | 10121312 | 10125313 |
| 114 | 10049364 | 10049395 | 10125282 | 10125313 | 16 | 10045394 | 10049395 | 10121312 | 10125313 |
| 115 | 46459835 | 46459866 | 46481483 | 46481514 | 19 | 46459835 | 46463836 | 46477513 | 46481514 |
| 116 | 46459835 | 46459866 | 46481483 | 46481514 | 19 | 46459835 | 46463836 | 46477513 | 46481514 |
| 117 | 41872387 | 41872418 | 41926859 | 41926890 | 21 | 41872387 | 41876388 | 41926859 | 41930860 |
| 118 | 41872387 | 41872418 | 41926859 | 41926890 | 21 | 41872387 | 41876388 | 41926859 | 41930860 |
| 119 | 16923015 | 16923046 | 16987493 | 16987524 | 22 | 16919045 | 16923046 | 16987493 | 16991494 |
| 120 | 16923015 | 16923046 | 16987493 | 16987524 | 22 | 16919045 | 16923046 | 16987493 | 16991494 |
| 121 | 65738736 | 65738767 | 65758131 | 65758162 | 3 | 65738736 | 65742737 | 65758131 | 65762132 |
| 122 | 65738736 | 65738767 | 65758131 | 65758162 | 3 | 65738736 | 65742737 | 65758131 | 65762132 |
| 123 | 65738736 | 65738767 | 65827279 | 65827310 | 3 | 65738736 | 65742737 | 65827279 | 65831280 |
| 124 | 65738736 | 65738767 | 65827279 | 65827310 | 3 | 65738736 | 65742737 | 65827279 | 65831280 |
| 125 | 79415953 | 79415984 | 79448857 | 79448888 | 7 | 79411983 | 79415984 | 79444887 | 79448888 |
| 126 | 79415953 | 79415984 | 79448857 | 79448888 | 7 | 79411983 | 79415984 | 79444887 | 79448888 |
| 127 | 10137237 | 10137268 | 10247633 | 10247664 | 8 | 10137237 | 10141238 | 10247633 | 10251634 |
| 128 | 10137237 | 10137268 | 10247633 | 10247664 | 8 | 10137237 | 10141238 | 10247633 | 10251634 |
| 129 | 16444934 | 16444965 | 16496760 | 16496791 | 3 | 16440964 | 16444965 | 16496760 | 16500761 |
| 130 | 16444934 | 16444965 | 16496760 | 16496791 | 3 | 16440964 | 16444965 | 16496760 | 16500761 |
| 131 | 36628023 | 36628054 | 36670823 | 36670854 | 13 | 36624053 | 36628054 | 36670823 | 36674824 |
| 132 | 36628023 | 36628054 | 36670823 | 36670854 | 13 | 36624053 | 36628054 | 36670823 | 36674824 |
| 133 | 38848295 | 38848326 | 38907082 | 38907113 | X | 38848295 | 38852296 | 38907082 | 38911083 |
| 134 | 38848295 | 38848326 | 38907082 | 38907113 | X | 38848295 | 38852296 | 38907082 | 38911083 |
| 135 | 68259991 | 68260022 | 68327682 | 68327713 | 14 | 68256021 | 68260022 | 68323712 | 68327713 |
| 136 | 68259991 | 68260022 | 68327682 | 68327713 | 14 | 68256021 | 68260022 | 68323712 | 68327713 |
| 137 | 127390647 | 127390678 | 127434266 | 127434297 | 5 | 127386677 | 127390678 | 127434266 | 127438267 |
| 138 | 127390647 | 127390678 | 127434266 | 127434297 | 5 | 127386677 | 127390678 | 127434266 | 127438267 |
| 139 | 30984126 | 30984157 | 31002238 | 31002269 | 21 | 30984126 | 30988127 | 30998268 | 31002269 |
| 140 | 30984126 | 30984157 | 31002238 | 31002269 | 21 | 30984126 | 30988127 | 30998268 | 31002269 |
| 141 | 78345645 | 78345676 | 78400290 | 78400321 | 14 | 78345645 | 78349646 | 78396320 | 78400321 |
| 142 | 78345645 | 78345676 | 78400290 | 78400321 | 14 | 78345645 | 78349646 | 78396320 | 78400321 |
| 143 | 84755923 | 84755954 | 84775145 | 84775176 | 6 | 84751953 | 84755954 | 84775145 | 84779146 |
| 144 | 84755923 | 84755954 | 84775145 | 84775176 | 6 | 84751953 | 84755954 | 84775145 | 84779146 |
| 145 | 3431982 | 3432013 | 3464169 | 3464200 | 8 | 3431982 | 3435983 | 3460199 | 3464200 |
| 146 | 3431982 | 3432013 | 3464169 | 3464200 | 8 | 3431982 | 3435983 | 3460199 | 3464200 |
| 147 | 33595213 | 33595244 | 33615647 | 33615678 | 11 | 33591243 | 33595244 | 33611677 | 33615678 |
| 148 | 33595213 | 33595244 | 33615647 | 33615678 | 11 | 33591243 | 33595244 | 33611677 | 33615678 |
| 149 | 23139410 | 23139441 | 23210381 | 23210412 | 16 | 23139410 | 23143411 | 23210381 | 23214382 |
| 150 | 23139410 | 23139441 | 23210381 | 23210412 | 16 | 23139410 | 23143411 | 23210381 | 23214382 |
| 151 | 65839372 | 65839403 | 65856122 | 65856153 | 3 | 65835402 | 65839403 | 65852152 | 65856153 |
| 152 | 65839372 | 65839403 | 65856122 | 65856153 | 3 | 65835402 | 65839403 | 65852152 | 65856153 |
| 153 | 84068704 | 84068735 | 84120868 | 84120899 | 11 | 84064734 | 84068735 | 84120868 | 84124869 |
| 154 | 84068704 | 84068735 | 84120868 | 84120899 | 11 | 84064734 | 84068735 | 84120868 | 84124869 |
| 155 | 38155445 | 38155476 | 38206549 | 38206580 | 2 | 38151475 | 38155476 | 38206549 | 38210550 |
| 156 | 38155445 | 38155476 | 38206549 | 38206580 | 2 | 38151475 | 38155476 | 38206549 | 38210550 |
| 157 | 43868341 | 43868372 | 43889253 | 43889284 | 3 | 43868341 | 43872342 | 43889253 | 43893254 |
| 158 | 43868341 | 43868372 | 43889253 | 43889284 | 3 | 43868341 | 43872342 | 43889253 | 43893254 |
| 159 | 103111808 | 103111839 | 103158499 | 103158530 | X | 103107838 | 103111839 | 103154529 | 103158530 |
| 160 | 103111808 | 103111839 | 103158499 | 103158530 | X | 103107838 | 103111839 | 103154529 | 103158530 |
| 161 | 36409666 | 36409697 | 36433268 | 36433299 | 1 | 36409666 | 36413667 | 36433268 | 36437269 |
| 162 | 36409666 | 36409697 | 36433268 | 36433299 | 1 | 36409666 | 36413667 | 36433268 | 36437269 |
| 163 | 49148928 | 49148959 | 49204579 | 49204610 | 11 | 49144958 | 49148959 | 49200609 | 49204610 |
| 164 | 49148928 | 49148959 | 49204579 | 49204610 | 11 | 49144958 | 49148959 | 49200609 | 49204610 |
| 165 | 13672704 | 13672735 | 13742062 | 13742093 | 12 | 13672704 | 13676705 | 13738092 | 13742093 |
| 166 | 13672704 | 13672735 | 13742062 | 13742093 | 12 | 13672704 | 13676705 | 13738092 | 13742093 |
| 167 | 169021738 | 169021769 | 169079530 | 169079561 | 2 | 169017768 | 169021769 | 169079530 | 169083531 |
| 168 | 169021738 | 169021769 | 169079530 | 169079561 | 2 | 169017768 | 169021769 | 169079530 | 169083531 |
| 169 | 20283807 | 20283838 | 20304911 | 20304942 | 2 | 20283807 | 20287808 | 20300941 | 20304942 |
| 170 | 20283807 | 20283838 | 20304911 | 20304942 | 2 | 20283807 | 20287808 | 20300941 | 20304942 |
| 171 | 20304911 | 20304942 | 20381252 | 20381283 | 2 | 20300941 | 20304942 | 20377282 | 20381283 |
| 172 | 20304911 | 20304942 | 20381252 | 20381283 | 2 | 20300941 | 20304942 | 20377282 | 20381283 |
| 173 | 84755923 | 84755954 | 84775145 | 84775176 | 6 | 84751953 | 84755954 | 84775145 | 84779146 |
| 174 | 84755923 | 84755954 | 84775145 | 84775176 | 6 | 84751953 | 84755954 | 84775145 | 84779146 |
| 175 | 52233796 | 52233827 | 52253135 | 52253166 | 8 | 52229826 | 52233827 | 52249165 | 52253166 |
| 176 | 52233796 | 52233827 | 52253135 | 52253166 | 8 | 52229826 | 52233827 | 52249165 | 52253166 |
| 177 | 65562483 | 65562514 | 65658401 | 65658432 | 8 | 65558513 | 65562514 | 65658401 | 65662402 |
| 178 | 65562483 | 65562514 | 65658401 | 65658432 | 8 | 65558513 | 65562514 | 65658401 | 65662402 |
| 179 | 38648333 | 38648364 | 38686830 | 38686861 | 9 | 38648333 | 38652334 | 38682860 | 38686861 |
| 180 | 38648333 | 38648364 | 38686830 | 38686861 | 9 | 38648333 | 38652334 | 38682860 | 38686861 |
| 181 | 28717278 | 28717309 | 28731416 | 28731447 | 7 | 28717278 | 28721279 | 28731416 | 28735417 |
| 182 | 28717278 | 28717309 | 28731416 | 28731447 | 7 | 28717278 | 28721279 | 28731416 | 28735417 |
| 183 | 36976432 | 36976463 | 37039732 | 37039763 | 7 | 36976432 | 36980433 | 37039732 | 37043733 |
| 184 | 36976432 | 36976463 | 37039732 | 37039763 | 7 | 36976432 | 36980433 | 37039732 | 37043733 |
| 185 | 77514867 | 77514898 | 77580704 | 77580735 | 2 | 77514867 | 77518868 | 77576734 | 77580735 |
| 186 | 77514867 | 77514898 | 77580704 | 77580735 | 2 | 77514867 | 77518868 | 77576734 | 77580735 |
| 187 | 55502863 | 55502894 | 55533743 | 55533774 | 1 | 55502863 | 55506864 | 55533743 | 55537744 |
| 188 | 55502863 | 55502894 | 55533743 | 55533774 | 1 | 55502863 | 55506864 | 55533743 | 55537744 |

TABLE 1.c6-continued

| | Probe Location | | | | 4 kb Sequence Location | | | |
|---|---|---|---|---|---|---|---|---|
| | Start1 | End1 | Start2 | End2 | Chr | Start1 | End1 | Start2 | End2 |
| 189 | 195535991 | 195536022 | 195589030 | 195589061 | 2 | 195535991 | 195539992 | 195585060 | 195589061 |
| 190 | 195535991 | 195536022 | 195589030 | 195589061 | 2 | 195535991 | 195539992 | 195585060 | 195589061 |
| 191 | 33273553 | 33273584 | 33317596 | 33317627 | 9 | 33273553 | 33277554 | 33317596 | 33321597 |
| 192 | 33273553 | 33273584 | 33317596 | 33317627 | 9 | 33273553 | 33277554 | 33317596 | 33321597 |
| 193 | 42093750 | 42093781 | 42144509 | 42144540 | 2 | 42093750 | 42097751 | 42140539 | 42144540 |
| 194 | 42093750 | 42093781 | 42144509 | 42144540 | 2 | 42093750 | 42097751 | 42140539 | 42144540 |
| 195 | 45370280 | 45370311 | 45421686 | 45421717 | 7 | 45366310 | 45370311 | 45421686 | 45425687 |
| 196 | 45370280 | 45370311 | 45421686 | 45421717 | 7 | 45366310 | 45370311 | 45421686 | 45425687 |
| 197 | 96311004 | 96311035 | 96328347 | 96328378 | 15 | 96307034 | 96311035 | 96328347 | 96332348 |
| 198 | 96311004 | 96311035 | 96328347 | 96328378 | 15 | 96307034 | 96311035 | 96328347 | 96332348 |
| 199 | 22663253 | 22663284 | 22709447 | 22709478 | 10 | 22659283 | 22663284 | 22705477 | 22709478 |
| 200 | 22663253 | 22663284 | 22709447 | 22709478 | 10 | 22659283 | 22663284 | 22705477 | 22709478 |
| 201 | 198074515 | 198074546 | 198099686 | 198099717 | 2 | 198070545 | 198074546 | 198099686 | 198103687 |
| 202 | 198074515 | 198074546 | 198099686 | 198099717 | 2 | 198070545 | 198074546 | 198099686 | 198103687 |
| 203 | 76403646 | 76403677 | 76480867 | 76480898 | 10 | 76403646 | 76407647 | 76480867 | 76484868 |
| 204 | 76403646 | 76403677 | 76480867 | 76480898 | 10 | 76403646 | 76407647 | 76480867 | 76484868 |
| 205 | 66539108 | 66539139 | 66592400 | 66592431 | 2 | 66539108 | 66543109 | 66592400 | 66596401 |
| 206 | 66539108 | 66539139 | 66592400 | 66592431 | 2 | 66539108 | 66543109 | 66592400 | 66596401 |
| 207 | 10103712 | 10103743 | 10175240 | 10175271 | 8 | 10099742 | 10103743 | 10171270 | 10175271 |
| 208 | 10103712 | 10103743 | 10175240 | 10175271 | 8 | 10099742 | 10103743 | 10171270 | 10175271 |
| 209 | 65562483 | 65562514 | 65637133 | 65637164 | 8 | 65558513 | 65562514 | 65637133 | 65641134 |
| 210 | 65562483 | 65562514 | 65637133 | 65637164 | 8 | 65558513 | 65562514 | 65637133 | 65641134 |
| 211 | 106698878 | 106698909 | 106745349 | 106745380 | 14 | 106694908 | 106698909 | 106741379 | 106745380 |
| 212 | 106698878 | 106698909 | 106745349 | 106745380 | 14 | 106694908 | 106698909 | 106741379 | 106745380 |

TABLE 1.c7

| | Probe | PCR-Primer1_ID | PCR_Primer1 |
|---|---|---|---|
| 113 | ORF13_16_10047306_10049395_10119747_10125313_FF | OBD159_225 | CTCAAGTTGTCACAGCATTACCACCT (SEQ ID NO: 438) |
| 114 | ORF13_16_10047306_10049395_10119747_10125313_FF | OBD159_225 | CTCAAGTTGTCACAGCATTACCACCT (SEQ ID NO: 438) |
| 115 | ORF13_19_46459835_46460902_46479838_46481514_RF | OBD159_229 | CAGTCTTGGCTGGTGATGATTCCTGA (SEQ ID NO: 440) |
| 116 | ORF13_19_46459835_46460902_46479838_46481514_RF | OBD159_229 | CAGTCTTGGCTGGTGATGATTCCTGA (SEQ ID NO: 440) |
| 117 | ORF13_21_41872387_41876215_41926859_41930173_RR | OBD159_233 | CCTCCTGAACCACCACCTCTGGC (SEQ ID NO: 442) |
| 118 | ORF13_21_41872387_41876215_41926859_41930173_RR | OBD159_233 | CCTCCTGAACCACCACCTCTGGC (SEQ ID NO: 442) |
| 119 | ORF13_22_16921135_16923046_16987493_16991720_FR | OBD159_237 | CAAGTAATCATTTCTCTTCATTTTG (SEQ ID NO: 444) |
| 120 | ORF13_22_16921135_16923046_16987493_16991720_FR | OBD159_237 | CAAGTAATCATTTCTCTTCATTTTG (SEQ ID NO: 444) |
| 121 | ORF13_3_65738736_65743505_65758131_65766427_RR | OBD159_241 | AAGCCCTTGTTGAGACCTACTTCCTC (SEQ ID NO: 446) |
| 122 | ORF13_3_65738736_65743505_65758131_65766427_RR | OBD159_241 | AAGCCCTTGTTGAGACCTACTTCCTC (SEQ ID NO: 446) |
| 123 | ORF13_3_65738736_65743505_65827279_65831993_RR | OBD159_245 | AAGCCCTTGTTGAGACCTACTTCCTC (SEQ ID NO: 446) |
| 124 | ORF13_3_65738736_65743505_65827279_65831993_RR | OBD159_245 | AAGCCCTTGTTGAGACCTACTTCCTC (SEQ ID NO: 446) |
| 125 | ORF13_7_79409384_79415984_79434265_79448888_FF | OBD159_249 | TAAACTTGCTGGTCTCTTCCACAGTA (SEQ ID NO: 450) |
| 126 | ORF13_7_79409384_79415984_79434265_79448888_FF | OBD159_249 | TAAACTTGCTGGTCTCTTCCACAGTA (SEQ ID NO: 450) |
| 127 | ORF_13_8_10137237_10138418_10247633_10250634_RR | OBD159_253 | GGCAGCCTACTTTGCTTGCTCTCAA |

TABLE 1.c7-continued

| Probe | PCR-Primer1_ID | PCR_Primer1 |
|---|---|---|
| | | (SEQ ID NO: 452) |
| 128 ORF13_8_10137237_10138418_10247633_10250634_RR | OBD159_253 | GGCAGCCTACTTTGCTTGCTCTCAA (SEQ ID NO: 452) |
| 129 ORF130_3_16438382_16444965_16496760_16499694_FR | OBD159_257 | CCACTACAACCACCATCACTCGC (SEQ ID NO: 454) |
| 130 ORF130_3_16438382_16444965_16496760_16499694_FR | OBD159_257 | CCACTACAACCACCATCACTCGC (SEQ ID NO: 454) |
| 131 ORF131_13_36625595_36628054_36670823_36673255_FR | OBD159_261 | GGTAGTCTCTGAGGTGTCATTCT (SEQ ID NO: 456) |
| 132 ORF131_13_36625595_36628054_36670823_36673255_FR | OBD159_261 | GGTAGTCTCTGAGGTGTCATTCT (SEQ ID NO: 456) |
| 133 ORF132_X_38848295_38850360_38907082_38913455_RR | OBD159_265 | GCCAACACATCAGGAGTGGGAAG (SEQ ID NO: 458) |
| 134 ORF132_X_38848295_38850360_38907082_38913455_RR | OBD159_265 | GCCAACACATCAGGAGTGGGAAG (SEQ ID NO: 458) |
| 135 ORF133_14_68255587_68260022_68325745_68327713_FF | OBD159_269 | GTGTTGGGCATTGAGAAAGTGGTGA A (SEQ ID NO: 460) |
| 136 ORF133_14_68255587_68260022_68325745_68327713_FF | OBD159_269 | GTGTTGGGCATTGAGAAAGTGGTGA A (SEQ ID NO: 460) |
| 137 ORF133_5_127388766_127390678_127434266_127436041_FR | OBD159_273 | CTCCTGACCTCAAATGATACTCTTGT (SEQ ID NO: 462) |
| 138 ORF133_5_127388766_127390678_127434266_127436041_FR | OBD159_273 | CTCCTGACCTCAAATGATACTCTTGT (SEQ ID NO: 462) |
| 139 ORF134_21_30984126_30988102_30998437_31002269_RF | OBD159_277 | TAACCAGGGTAGCCTTGATGCCAGC (SEQ ID NO: 464) |
| 140 ORF134_21_30984126_30988102_30998437_31002269_RF | OBD159_277 | TAACCAGGGTAGCCTTGATGCCAGC (SEQ ID NO: 464) |
| 141 ORF135_14_78345645_78349226_78398012_78400321_RF | OBD159_281 | GCCAAGAAGTAGTAGTTATTCCCTCC (SEQ ID NO: 466) |
| 142 ORF135_14_78345645_78349226_78398012_78400321_RF | OBD159_281 | GCCAAGAAGTAGTAGTTATTCCCTCC (SEQ ID NO: 466) |
| 143 ORF135_6_84752549_84755954_84775145_84786636_FR | OBD159_285 | AAGACATTGTTTAGCAACTTCCAA (SEQ ID NO: 468) |
| 144 ORF135_6_84752549_84755954_84775145_84786636_FR | OBD159_285 | AAGACATTGTTTAGCAACTTCCAA (SEQ ID NO: 468) |
| 145 ORF_135_8_3431982_3435558_3460548_3464200_RF | OBD159_289 | CAGCAGCACATCACAGGAAACAGTT C (SEQ ID NO: 470) |
| 146 ORF135_8_3431982_3435558_3460548_3464200_RF | OBD159_289 | CAGCAGCACATCACAGGAAACAGTT C (SEQ ID NO: 470) |
| 147 ORF136_11_33584612_33595244_33612657_33615678_FF | OBD159_293 | GAATAAGCACTTCTTCTTGGATTAGC (SEQ ID NO: 472) |
| 148 ORF136_11_33584612_33595244_33612657_33615678_FF | OBD159_293 | GAATAAGCACTTCTTCTTGGATTAGC (SEQ ID NO: 472) |
| 149 ORF136_16_23139410_23143862_23210381_23212701_RR | OBD159_297 | GCAGGAAAACCAGGAAGGCAGAG (SEQ ID NO: 474) |
| 150 ORF136_16_23139410_23143862_23210381_23212701_RR | OBD159_297 | GCAGGAAAACCAGGAAGGCAGAG (SEQ ID NO: 474) |
| 151 ORF136_3_65835051_65839403_65852931_65856153_FF | OBD159_301 | ACCTACTGTGCTGCCAGACATAGAAA (SEQ ID NO: 476) |
| 152 ORF136_3_65835051_65839403_65852931_65856153_FF | OBD159_301 | ACCTACTGTGCTGCCAGACATAGAAA (SEQ ID NO: 476) |

TABLE 1.c7-continued

| Probe | PCR-Primer1_ID | PCR_Primer1 |
|---|---|---|
| 153 ORF138_11_84067130_84068735_84120868_84126600_FR | OBD159_305 | CCAGTTATTTGCTCCAGTGTTCCTCC (SEQ ID NO: 478) |
| 154 ORF138_11_84067130_84068735_84120868_84126600_FR | OBD159_305 | CCAGTTATTTGCTCCAGTGTTCCTCC (SEQ ID NO: 478) |
| 155 ORF_139_2_38148629_38155476_38206549_38210637_FR | OBD159_309 | CCCGCCCACATCCTGAGAATCCTTTT (SEQ ID NO: 480) |
| 156 ORF_139_2_38148629_38155476_38206549_38210637_FR | OBD159_309 | CCCGCCCACATCCTGAGAATCCTTTT (SEQ ID NO: 480) |
| 157 ORF139_3_43868341_43870688_43889253_43893962_RR | OBD159_313 | CTCTTCTGACCCTTTGCCCTTCCCAT (SEQ ID NO: 482) |
| 158 ORF_139_3_43868341_43870688_43889253_43893962_RR | OBD159_313 | CTCTTCTGACCCTTTGCCCTTCCCAT (SEQ ID NO: 482) |
| 159 ORF139_X_103107164_103111839_103149176_103158530_FF | OBD159_317 | GGGATGCCTGGGACATAAGTCAGATG (SEQ ID NO: 484) |
| 160 ORF139_X_103107164_103111839_103149176_103158530_FF | OBD159_317 | GGGATGCCTGGGACATAAGTCAGATG (SEQ ID NO: 484) |
| 161 ORF14_1_36409666_36411937_36433268_36434547_RR | OBD159_165 | GAAGCGAGTTGCTGTCACTGGAG (SEQ ID NO: 248) |
| 162 ORF14_1_36409666_36411937_36433268_36434547_RR | OBD159_165 | GAAGCGAGTTGCTGTCACTGGAG (SEQ ID NO: 248) |
| 163 ORF14_11_49143461_49148959_49200052_49204610_FF | OBD159_321 | GTTTCAGGACCACCCTCTACACC (SEQ ID NO: 60) |
| 164 ORF14_11_49143461_49148959_49200052_49204610_FF | OBD159_321 | GTTTCAGGACCACCCTCTACACC (SEQ ID NO: 60) |
| 165 ORF14_12_13672704_13680228_13739178_13742093_RF | OBD159_325 | AGCCCTTGGCACATAGTATTCACTCA (SEQ ID NO: 490) |
| 166 ORF14_12_13672704_13680228_13739178_13742093_RF | OBD159_325 | AGCCCTTGGCACATAGTATTCACTCA (SEQ ID NO: 490) |
| 167 ORF14_2_169020149_169021769_169079530_169081990_FR | OBD159_329 | CAACCTAACACAACATAGCCTGC (SEQ ID NO: 66) |
| 168 ORF14_2_169020149_169021769_169079530_169081990_FR | OBD159_329 | CAACCTAACACAACATAGCCTGC (SEQ ID NO: 66) |
| 169 ORF14_2_20283807_20286153_20303337_20304942_RF | OBD159_333 | CATTTGTCAACTCACACTCTAAAA (SEQ ID NO: 92) |
| 170 ORF14_2_20283807_20286153_20303337_20304942_RF | OBD159_333 | CATTTGTCAACTCACACTCTAAAA (SEQ ID NO: 92) |
| 171 ORF14_2_20303337_20304942_20379482_20381283_FF | OBD159_337 | ACATTTGTCAACTCACACTCTAAA (SEQ ID NO: 496) |
| 172 ORF14_2_20303337_20304942_20379482_20381283_FF | OBD159_337 | ACATTTGTCAACTCACACTCTAAA (SEQ ID NO: 496) |
| 173 ORF14_6_84752549_84755954_84775145_84786636_FR | OBD159_285 | AAGACATTGTTTAGCAACTTCCAA (SEQ ID NO: 468) |
| 174 ORF14_6_84752549_84755954_84775145_84786636_FR | OBD159_285 | AAGACATTGTTTAGCAACTTCCAA (SEQ ID NO: 468) |
| 175 ORF14_8_52230322_52233827_52248401_52253166_FF | OBD159_341 | TATTATTTTCATTGGCTTTCACCAG (SEQ ID NO: 500) |
| 176 ORF14_8_52230322_52233827_52248401_52253166_FF | OBD159_341 | TATTATTTTCATTGGCTTTCACCAG (SEQ ID NO: 500) |
| 177 ORF14_8_65560550_65562514_65658401_65661888_FR | OBD159_345 | CCTTGATAGAGAAAACAAAATGCTT (SEQ ID NO: 502) |
| 178 ORF14_8_65560550_65562514_65658401_65661888_FR | OBD159_345 | CCTTGATAGAGAAAACAAAATGCTT (SEQ ID NO: 502) |

TABLE 1.c7-continued

| Probe | PCR-Primer1_ID | PCR_Primer1 |
|---|---|---|
| 179 ORF14_9_38648333_38653476_38681931_38686861_RF | OBD159_349 | CAGAAGTTCACAGGCAGGGTGTC (SEQ ID NO: 258) |
| 180 ORF14_9_38648333_38653476_38681931_38686861_RF | OBD159_349 | CAGAAGTTCACAGGCAGGGTGTC (SEQ ID NO: 258) |
| 181 ORF140_7_28717278_28719857_28731416_28736388_RR | OBD159_353 | CCCCAGAGTTCCTTTGGCTCCCA (SEQ ID NO: 506) |
| 182 ORF140_7_28717278_28719857_28731416_28736388_RR | OBD159_353 | CCCCAGAGTTCCTTTGGCTCCCA (SEQ ID NO: 506) |
| 183 ORF_140_7_36976432_36980351_37039732_37049390_RR | OBD159_357 | CAATGGGATACTTCTCTTGGGTTTGG (SEQ ID NO: 508) |
| 184 ORF140_7_36976432_36980351_37039732_37049390_RR | OBD159_357 | CAATGGGATACTTCTCTTGGGTTTGG (SEQ ID NO: 508) |
| 185 ORF141_2_77514867_77519288_77576705_77580735_RF | OBD159_361 | GGTGATGGGACTAAGCCTCAGGTTTT (SEQ ID NO: 510) |
| 186 ORF141_2_77514867_77519288_77576705_77580735_RF | OBD159_361 | GGTGATGGGACTAAGCCTCAGGTTTT (SEQ ID NO: 510) |
| 187 ORF142_1_55502863_55511336_55533743_55538240_RR | OBD159_365 | CCAGAGAGCCAGTGCTTTCAACTCCA (SEQ ID NO: 512) |
| 188 ORF142_1_55502863_55511336_55533743_55538240_RR | OBD159_365 | CCAGAGAGCCAGTGCTTTCAACTCCA (SEQ ID NO: 512) |
| 189 ORF142_2_195535991_195542111_195583610_195589061_RF | OBD159_369 | CAGGCTATTGGAATGGCTGAAGTGTG (SEQ ID NO: 514) |
| 190 ORF142_2_195535991_195542111_195583610_195589061_RF | OBD159_369 | CAGGCTATTGGAATGGCTGAAGTGTG (SEQ ID NO: 514) |
| 191 ORF144_9_33273553_33275175_33317596_33319558_RR | OBD159_373 | CCTACACACACACAACAGCAAAATAA (SEQ ID NO: 516) |
| 192 ORF_144_9_33273553_33275175_33317596_33319558_RR | OBD159_373 | CCTACACACACACAACAGCAAAATAA (SEQ ID NO: 516) |
| 193 ORF145_2_42093750_42101196_42140119_42144540_RF | OBD159_377 | AGGGAAGAAGGCTGCTATGTATTGGG (SEQ ID NO: 518) |
| 194 ORF145_2_42093750_42101196_42140119_42144540_RF | OBD159_377 | AGGGAAGAAGGCTGCTATGTATTGGG (SEQ ID NO: 518) |
| 195 ORF145_7_45364155_45370311_45421686_45426816_FR | OBD159_381 | TTTAGCAGTGAAGTCATCAGGTCCT (SEQ ID NO: 520) |
| 196 ORF145_7_45364155_45370311_45421686_45426816_FR | OBD159_381 | TTTAGCAGTGAAGTCATCAGGTCCT (SEQ ID NO: 520) |
| 197 ORF147_15_96308452_96311035_96328347_96331473_FR | OBD159_385 | TCAAAATGATAGGTTCACAGTTCGTG (SEQ ID NO: 522) |
| 198 ORF147_15_96308452_96311035_96328347_96331473_FR | OBD159_385 | TCAAAATGATAGGTTCACAGTTCGTG (SEQ ID NO: 522) |
| 199 ORF148_10_22661441_22663284_22705207_22709478_FF | OBD159_389 | CACATTCTTTTGGGCTCTGCCACTCC (SEQ ID NO: 524) |
| 200 ORF148_10_22661441_22663284_22705207_22709478_FF | OBD159_389 | CACATTCTTTTGGGCTCTGCCACTCC (SEQ ID NO: 524) |
| 201 ORF148_2_198067347_198074546_198099686_198102962_FR | OBD159_393 | GGACTCCAAAGTGACTAAAATCAATG (SEQ ID NO: 526) |
| 202 ORF148_2_198067347_198074546_198099686_198102962_FR | OBD159_393 | GGACTCCAAAGTGACTAAAATCAATG (SEQ ID NO: 526) |
| 203 ORF15_10_76403646_76410014_76480867_76489182_RR | OBD159_397 | AGAACCCTGGTCCCACCCCTTTA (SEQ ID NO: 528) |
| 204 ORF15_10_76403646_76410014_76480867_76489182_RR | OBD159_397 | AGAACCCTGGTCCCACCCCTTTA |

TABLE 1.c7-continued

| Probe | PCR-Primer1_ID | PCR_Primer1 |
|---|---|---|
| | | (SEQ ID NO: 528) |
| 205 ORF15_2_66539108_66541258_66592400_66595314_RR | OBD159_401 | GTAATACCAGCACTTTAGGAGGC (SEQ ID NO: 530) |
| 206 ORF15_2_66539108_66541258_66592400_66595314_RR | OBD159_401 | GTAATACCAGCACTTTAGGAGGC (SEQ ID NO: 530) |
| 207 ORF15_8_10100695_10103743_10173552_10175271_FF | OBD159_405 | AGTGAGATAATGTGCCTGAAAGCAA T (SEQ ID NO: 532) |
| 208 ORF15_8_10100695_10103743_10173552_10175271_FF | OBD159_405 | AGTGAGATAATGTGCCTGAAAGCAA T (SEQ ID NO: 532) |
| 209 ORF15_8_65560550_65562514_65637133_65640837_FR | OBD159_409 | ACCTTGATAGAGAAAACAAAATGCT (SEQ ID NO: 534) |
| 210 ORF15_8_65560550_65562514_65637133_65640837_FR | OBD159_409 | ACCTTGATAGAGAAAACAAAATGCT (SEQ ID NO: 534) |
| 211 ORF151_14_106693397_106698909_106739902_106745380_FF | OBD159_413 | CGCAACGGGTCCCAGCATCATCT (SEQ ID NO: 536) |
| 212 ORF151_14_106693397_106698909_106739902_106745380_FF | OBD159_413 | CGCAACGGGTCCCAGCATCATCT (SEQ ID NO: 536) |

TABLE 1.c8

| | PCR-Primer2_ID | PCR_Primer2 | Marker | GLMNET |
|---|---|---|---|---|
| 113 | OBD159_227 | CTTGACCTCTTGACGCCTTCTACTTC (SEQ ID NO: 538) | OBD159_225_227 | -0.003478138 |
| 114 | OBD159_227 | CTTGACCTCTTGACGCCTTCTACTTC (SEQ ID NO: 538) | OBD159_225_227 | -0.003478138 |
| 115 | OBD159_231 | CCCTTCAGTGGAACCTTACCCAACAA (SEQ ID NO: 540) | OBD159_229_231 | -0.002532463 |
| 116 | OBD159_231 | CCCTTCAGTGGAACCTTACCCAACAA (SEQ ID NO: 540) | OBD159_229_231 | -0.002532463 |
| 117 | OBD159_235 | GGAGTTCTTTCCTTGGGTGTTACAG (SEQ ID NO: 542) | OBD159_233_235 | -0.001863826 |
| 118 | OBD159_235 | GGAGTTCTTTCCTTGGGTGTTACAG (SEQ ID NO: 542) | OBD159_233_235 | -0.001863826 |
| 119 | OBD159_239 | GATTCCTAAGAAACCTACCATTAT (SEQ ID NO: 544) | OBD159_237_239 | -0.001138844 |
| 120 | OBD159_239 | GATTCCTAAGAAACCTACCATTAT (SEQ ID NO: 544) | OBD159_237_239 | -0.001138844 |
| 121 | OBD159_243 | TGTGGAAAGGTGATTGGCTCAACAGC (SEQ ID NO: 546) | OBD159_241_243 | -0.00258233 |
| 122 | OBD159_243 | TGTGGAAAGGTGATTGGCTCAACAGC (SEQ ID NO: 546) | OBD159_241_243 | -0.00258233 |
| 123 | OBD159_247 | GAGCAAGAGCAGTTTGGCTGTGTTGT (SEQ ID NO: 548) | OBD159_245_247 | -0.00500142 |
| 124 | OBD159_247 | GAGCAAGAGCAGTTTGGCTGTGTTGT (SEQ ID NO: 548) | OBD159_245_247 | -0.00500142 |
| 125 | OBD159_251 | CATTGCTCTACCCCACCTTCTGAGGA (SEQ ID NO: 550) | OBD159_249_251 | -0.000699189 |
| 126 | OBD159_251 | CATTGCTCTACCCCACCTTCTGAGGA (SEQ ID NO: 550) | OBD159_249_251 | -0.000699189 |
| 127 | OBD159_255 | CTCTCCTTCTGTGTATGGGTAAGACC (SEQ ID NO: 552) | OBD159_253_255 | -0.004180686 |

TABLE 1.c8-continued

| | PCR-Primer2_ID | PCR_Primer2 | Marker | GLMNET |
|---|---|---|---|---|
| 128 | OBD159_255 | CTCTCCTTCTGTGTATGGGTAAGACC (SEQ ID NO: 552) | OBD159_253_255 | -0.004180686 |
| 129 | OBD159_259 | GTTTGGGCGGTTTCCAGGATGGG (SEQ ID NO: 554) | OBD159_257_259 | -0.003029176 |
| 130 | OBD159_259 | GTTTGGGCGGTTTCCAGGATGGG (SEQ ID NO: 554) | OBD159_257_259 | -0.003029176 |
| 131 | OBD159_263 | CTACTAAGTGGCTAATGGGTGGG (SEQ ID NO: 556) | OBD159_261_263 | -0.003552931 |
| 132 | OBD159_263 | CTACTAAGTGGCTAATGGGTGGG (SEQ ID NO: 556) | OBD159_261_263 | -0.003552931 |
| 133 | OBD159_267 | GCTTCCCTCCTCTGTAGCCAATAGC (SEQ ID NO: 558) | OBD159_265_267 | -0.001420022 |
| 134 | OBD159_267 | GCTTCCCTCCTCTGTAGCCAATAGC (SEQ ID NO: 558) | OBD159_265_267 | -0.001420022 |
| 135 | OBD159_271 | GCCAAAGACTCCTCTGGGAATCCAAC (SEQ ID NO: 560) | OBD159_269_271 | -0.003881009 |
| 136 | OBD159_271 | GCCAAAGACTCCTCTGGGAATCCAAC (SEQ ID NO: 560) | OBD159_269_271 | -0.003881009 |
| 137 | OBD159_275 | TCTTGGCATAAAGCAGGGCTCCAGGA (SEQ ID NO: 562) | OBD159_273_275 | -0.000941074 |
| 138 | OBD159_275 | TCTTGGCATAAAGCAGGGCTCCAGGA (SEQ ID NO: 562) | OBD159_273_275 | -0.000941074 |
| 139 | OBD159_279 | TTGTCAGTGTTACAGGATTAGACTCC (SEQ ID NO: 564) | OBD159_277_279 | -0.002446219 |
| 140 | OBD159_279 | TTGTCAGTGTTACAGGATTAGACTCC (SEQ ID NO: 564) | OBD159_277_279 | -0.002446219 |
| 141 | OBD159_283 | CCTCAACATCCCAAAACGGGTTCCTC (SEQ ID NO: 566) | OBD159_281_283 | -0.003527946 |
| 142 | OBD159_283 | CCTCAACATCCCAAAACGGGTTCCTC (SEQ ID NO: 566) | OBD159_281_283 | -0.003527946 |
| 143 | OBD159_287 | TTTGTAAACGGTTGGGAGACTTAG (SEQ ID NO: 568) | OBD159_285_287 | -0.002652581 |
| 144 | OBD159_287 | TTTGTAAACGGTTGGGAGACTTAG (SEQ ID NO: 568) | OBD159_285_287 | -0.002652581 |
| 145 | OBD159_291 | AACTGGGTTCTGGGACTITTCCTCAG (SEQ ID NO: 570) | OBD159_289_291 | -0.003934436 |
| 146 | OBD159_291 | AACTGGGTTCTGGGACTITTCCTCAG (SEQ ID NO: 570) | OBD159_289_291 | -0.003934436 |
| 147 | OBD159_295 | GGGATGTTGCCTCCGAGACAAAA (SEQ ID NO: 572) | OBD159_293_295 | -0.005396785 |
| 148 | OBD159_295 | GGGATGTTGCCTCCGAGACAAAA (SEQ ID NO: 572) | OBD159_293_295 | -0.005396785 |
| 149 | OBD159_299 | GGGAGCCAGAGAACACCTGCTTC (SEQ ID NO: 574) | OBD159_297_299 | -0.000755854 |
| 150 | OBD159_299 | GGGAGCCAGAGAACACCTGCTTC (SEQ ID NO: 574) | OBD159_297_299 | -0.000755854 |
| 151 | OBD159_303 | GAGGGACTGGGTGGGAGGAGTATTTT (SEQ ID NO: 576) | OBD159_301_303 | -0.000778321 |
| 152 | OBD159_303 | GAGGGACTGGGTGGGAGGAGTATTTT (SEQ ID NO: 576) | OBD159_301_303 | -0.000778321 |
| 153 | OBD159_307 | CTCCAACTGACCACTAAAACCACATA (SEQ ID NO: 578) | OBD159_305_307 | -0.001663304 |

TABLE 1.c8-continued

| | PCR-Primer2_ID | PCR_Primer2 | Marker | GLMNET |
|---|---|---|---|---|
| 154 | OBD159_307 | CTCCAACTGACCACTAAAACCACATA (SEQ ID NO: 578) | OBD159_305_307 | -0.001663304 |
| 155 | OBD159_311 | AGTTCCACTTCCCCATACTCACAAAC (SEQ ID NO: 580) | OBD159_309_311 | -0.001494243 |
| 156 | OBD159_311 | AGTTCCACTTCCCCATACTCACAAAC (SEQ ID NO: 580) | OBD159_309_311 | -0.001494243 |
| 157 | OBD159_315 | GGGCTAAAGTGGGTAAAGTCTCAAAA (SEQ ID NO: 582) | OBD159_313_315 | -0.001782575 |
| 158 | OBD159_315 | GGGCTAAAGTGGGTAAAGTCTCAAAA (SEQ ID NO: 582) | OBD159_313_315 | -0.001782575 |
| 159 | OBD159_319 | GACACTCACACACAGAAATACTGCCA (SEQ ID NO: 584) | OBD159_317_319 | -0.002307627 |
| 160 | OBD159_319 | GACACTCACACACAGAAATACTGCCA (SEQ ID NO: 584) | OBD159_317_319 | -0.002307627 |
| 161 | OBD159_167 | CCCCAACACAAACTGTCCTCAGGC (SEQ ID NO: 308) | OBD159_165_167 | -0.005406694 |
| 162 | OBD159_167 | CCCCAACACAAACTGTCCTCAGGC (SEQ ID NO: 308) | OBD159_165_167 | -0.005406694 |
| 163 | OBD159_323 | GACCATACCTTGCCAGACCTCCAC (SEQ ID NO: 588) | OBD159_321_323 | -0.000820401 |
| 164 | OBD159_323 | GACCATACCTTGCCAGACCTCCAC (SEQ ID NO: 588) | OBD159_321_323 | -0.000820401 |
| 165 | OBD159_327 | TATGTTGTTGCCCTTGATACGGTAGC (SEQ ID NO: 590) | OBD159_325_327 | -0.003236838 |
| 166 | OBD159_327 | TATGTTGTTGCCCTTGATACGGTAGC (SEQ ID NO: 590) | OBD159_325_327 | -0.003236838 |
| 167 | OBD159_331 | GGATTACAGGCGTGAGCCACCAC (SEQ ID NO: 592) | OBD159_329_331 | -0.001954353 |
| 168 | OBD159_331 | GGATTACAGGCGTGAGCCACCAC (SEQ ID NO: 592) | OBD159_329_331 | -0.001954353 |
| 169 | OBD159_335 | ATGAGGCACTTGATTTTGAACTTC (SEQ ID NO: 594) | OBD159_333_335 | -0.003110365 |
| 170 | OBD159_335 | ATGAGGCACTTGATTTTGAACTTC (SEQ ID NO: 594) | OBD159_333_335 | -0.003110365 |
| 171 | OBD159_339 | TATCCAGTCTCCCAACATCATTTGT (SEQ ID NO: 596) | OBD159_337_339 | -0.002009345 |
| 172 | OBD159_339 | TATCCAGTCTCCCAACATCATTTGT (SEQ ID NO: 596) | OBD159_337_339 | -0.002009345 |
| 173 | OBD159_287 | TTTGTAAACGGTTGGGAGACTTAG (SEQ ID NO: 568) | OBD159_285_287 | -0.00372894 |
| 174 | OBD159_287 | TTTGTAAACGGTTGGGAGACTTAG (SEQ ID NO: 568) | OBD159_285_287 | -0.00372894 |
| 175 | OBD159_343 | TATTTCCCTAACATAACGATAGTGC (SEQ ID NO: 600) | OBD159_341_343 | -0.002079504 |
| 176 | OBD159_343 | TATTTCCCTAACATAACGATAGTGC (SEQ ID NO: 600) | OBD159_341_343 | -0.002079504 |
| 177 | OBD159_347 | GTAGAAGAGAAACCCAGATAAATA (SEQ ID NO: 602) | OBD159_345_347 | -0.001315086 |
| 178 | OBD159_347 | GTAGAAGAGAAACCCAGATAAATA (SEQ ID NO: 602) | OBD159_345_347 | -0.001315086 |
| 179 | OBD159_351 | GACCACAGGCACCACCATACCCT (SEQ ID NO: 604) | OBD159_349_351 | -0.002703631 |

TABLE 1.c8-continued

| | PCR-Primer2_ID | PCR_Primer2 | Marker | GLMNET |
|---|---|---|---|---|
| 180 | OBD159_351 | GACCACAGGCACCACCATACCCT (SEQ ID NO: 604) | OBD159_349_351 | -0.002703631 |
| 181 | OBD159_355 | CCCGAACTCCCTTCCTGTTTTGG (SEQ ID NO: 606) | OBD159_353_355 | -0.001783895 |
| 182 | OBD159_355 | CCCGAACTCCCTTCCTGTTTTGG (SEQ ID NO: 606) | OBD159_353_355 | -0.001783895 |
| 183 | OBD159_359 | ACAGGAAAGCCTACTGGACAACATTG (SEQ ID NO: 608) | OBD159_357_359 | -0.002901823 |
| 184 | OBD159_359 | ACAGGAAAGCCTACTGGACAACATTG (SEQ ID NO: 608) | OBD159_357_359 | -0.002901823 |
| 185 | OBD159_363 | AGTGTGCTTGGTTGAACTGAATCATT (SEQ ID NO: 610) | OBD159_361_363 | -0.002666837 |
| 186 | OBD159_363 | AGTGTGCTTGGTTGAACTGAATCATT (SEQ ID NO: 610) | OBD159_361_363 | -0.002666837 |
| 187 | OBD159_367 | GGCAACTAACACTTGTCTCACCTTCA (SEQ ID NO: 612) | OBD159_365_367 | -0.002519385 |
| 188 | OBD159_367 | GGCAACTAACACTTGTCTCACCTTCA (SEQ ID NO: 612) | OBD159_365_367 | -0.002519385 |
| 189 | OBD159_371 | CCTGCTCTGCCACTAACCAAGTATGT (SEQ ID NO: 614) | OBD159_369_371 | -0.003311287 |
| 190 | OBD159_371 | CCTGCTCTGCCACTAACCAAGTATGT (SEQ ID NO: 614) | OBD159_369_371 | -0.003311287 |
| 191 | OBD159_375 | GGACTACAGGCGTGAGCCACCAC (SEQ ID NO: 616) | OBD159_373_375 | -0.002586717 |
| 192 | OBD159_375 | GGACTACAGGCGTGAGCCACCAC (SEQ ID NO: 616) | OBD159_373_375 | -0.002586717 |
| 193 | OBD159_379 | ATCCATCCTTCTCACAGCAGCCAAGA (SEQ ID NO: 618) | OBD159_377_379 | -0.000261394 |
| 194 | OBD159_379 | ATCCATCCTTCTCACAGCAGCCAAGA (SEQ ID NO: 618) | OBD159_377_379 | -0.000261394 |
| 195 | OBD159_383 | ATTGAATAGCCATCAGCAAGAAAA (SEQ ID NO: 620) | OBD159_381_383 | -0.003357596 |
| 196 | OBD159_383 | ATTGAATAGCCATCAGCAAGAAAA (SEQ ID NO: 620) | OBD159_381_383 | -0.003357596 |
| 197 | OBD159_387 | TGAGACTTCCATAGCAGATTACCTTT (SEQ ID NO: 622) | OBD159_385_387 | -0.004574718 |
| 198 | OBD159_387 | TGAGACTTCCATAGCAGATTACCTTT (SEQ ID NO: 622) | OBD159_385_387 | -0.004574718 |
| 199 | OBD159_391 | GAACCTCATCTGTCTAACCACAAACC (SEQ ID NO: 624) | OBD159_389_391 | -0.002633812 |
| 200 | OBD159_391 | GAACCTCATCTGTCTAACCACAAACC (SEQ ID NO: 624) | OBD159_389_391 | -0.002633812 |
| 201 | OBD159_395 | TAGTTCAAGTTCTTCTCAAAAGCCCC (SEQ ID NO: 626) | OBD159_393_395 | -0.003551604 |
| 202 | OBD159_395 | TAGTTCAAGTTCTTCTCAAAAGCCCC (SEQ ID NO: 626) | OBD159_393_395 | -0.003551604 |
| 203 | OBD159_399 | GAGTCGCTGTCCCAATGGCAGGA (SEQ ID NO: 628) | OBD159_397_399 | -0.004114077 |
| 204 | OBD159_399 | GAGTCGCTGTCCCAATGGCAGGA (SEQ ID NO: 628) | OBD159_397_399 | -0.004114077 |
| 205 | OBD159_403 | CCATTTTACAGGTGAACAAACTGATG (SEQ ID NO: 630) | OBD159_401_403 | -0.004584406 |

TABLE 1.c8-continued

| | PCR-Primer2_ID | PCR_Primer2 | Marker | GLMNET |
|---|---|---|---|---|
| 206 | OBD159_403 | CCATTTTACAGGTGAACAAACTGATG (SEQ ID NO: 630) | OBD159_401_403 | -0.004584406 |
| 207 | OBD159_407 | TAGCCCCTTTCCCACAACTTTTCTGC (SEQ ID NO: 632) | OBD159_405_407 | -0.002097489 |
| 208 | OBD159_407 | TAGCCCCTTTCCCACAACTTTTCTGC (SEQ ID NO: 632) | OBD159_405_407 | -0.002097489 |
| 209 | OBD159_411 | GTTCAAGGTTTCCCTCTGCTTCTA (SEQ ID NO: 634) | OBD159_409_411 | -0.001313422 |
| 210 | OBD159_411 | GTTCAAGGTTTCCCTCTGCTTCTA (SEQ ID NO: 634) | OBD159_409_411 | -0.001313422 |
| 211 | OBD159_415 | CTTGCCTTACCACCTGCTCTTCC (SEQ ID NO: 636) | OBD159_413_415 | -0.003147124 |
| 212 | OBD159_415 | CTTGCCTTACCACCTGCTCTTCC (SEQ ID NO: 636) | OBD159_413_415 | -0.003147124 |

TABLE 1.c9

| | Gene |
|---|---|
| 113 | GRIN2A; rs7192557 |
| 114 | GRIN2A; rs7192557 |
| 115 | PNMAL1; PNMAL2; PPP5D1 |
| 116 | PNMAL1; PNMAL2; PPP5D1 |
| 117 | C2CD2; PRDM15; ZBTB21; rs451390 |
| 118 | C2CD2; PRDM15; ZBTB21; rs451390 |
| 119 | GAB4; rs41433045 |
| 120 | GAB4; rs41433045 |
| 121 | MAGI1; rs11924265 |
| 122 | MAGI1; rs11924265 |
| 123 | MAGI1; rs7633294; rs11924265; rs1909492; rs145965284 |
| 124 | MAGI1; rs7633294; rs11924265; rs1909492; rs145965284 |
| 125 | MAGI2; rs1135402912 |
| 126 | MAGI2; rs1135402912 |
| 127 | MSRA; rs7001567; rs10107815; rs73191547; rs17749155; rs2975735 |
| 128 | MSRA; rs7001567; rs10107815; rs73191547; rs17749155; rs2975735 |
| 129 | RFTN1; rs3856834 |
| 130 | RFTN1; rs3856834 |
| 131 | SERTM1; rs11619726 |
| 132 | SERTM1; rs11619726 |
| 133 | MID1IP1; rs199860 |
| 134 | MID1IP1; rs199860 |
| 135 | RAD51B; rs1570106; rs17105278; rs4902562; rs3784099; rs2208397; rs911263; rs2104047; rs1950897; rs11158728; rs927220; rs61985136; rs8017304; rs1956529; rs4902566 |
| 136 | RAD51B; rs1570106; rs17105278; rs4902562; rs3784099; rs2208397; rs911263; rs2104047; rs1950897; rs11158728; rs927220; rs61985136; rs8017304; rs1956529; rs4902566 |
| 137 | MEGF10; rs387907071; rs143954261; rs387907073; rs794726679; rs1057518682; rs794726677 |
| 138 | MEGF10; rs387907071; rs143954261; rs387907073; rs794726679; rs1057518682; rs794726677 |
| 139 | KRTAP19-8; rs8134605 |
| 140 | KRTAP19-8; rs8134605 |
| 141 | NRXN3; rs11624704 |
| 142 | NRXN3; rs11624704 |
| 143 | TBX18; rs869320679; rs797045022; rs77693245 |
| 144 | TBX18; rs869320679; rs797045022; rs77693245 |
| 145 | CSMD1; rs2938236; rs17066135 |
| 146 | CSMD1; rs2938236; rs17066135 |
| 147 | KIAA1549L; rs4755718; rs2076625 |
| 148 | KIAA1549L; rs4755718; rs2076625 |
| 149 | SCNN1G; USP31; rs137853342; rs5736 |
| 150 | SCNN1G; USP31; rs137853342; rs5736 |
| 151 | MAGI1; rs145965284 |

TABLE 1.c9-continued

| | Gene |
|---|---|
| 152 | MAGI1; rs145965284 |
| 153 | DLG2; rs790356 |
| 154 | DLG2; rs790356 |
| 155 | ATL2; CYP1B1 |
| 156 | ATL2; CYP1B1 |
| 157 | rs6441806; rs75594032 |
| 158 | rs6441806; rs75594032 |
| 159 | BEX4; NXF3 |
| 160 | BEX4; NXF3 |
| 161 | LSM10; OSCP1 |
| 162 | LSM10; OSCP1 |
| 163 | FOLH1; rs202676; rs368939818; rs61886492; rs770894245; rs747052707; rs202680 |
| 164 | FOLH1; rs202676; rs368939818; rs61886492; rs770894245; rs747052707; rs202680 |
| 165 | GRIN2B; rs1060499526; rs2192970; rs2284411; rs2268118 |
| 166 | GRIN2B; rs1060499526; rs2192970; rs2284411; rs2268118 |
| 167 | ABCB11; DHRS9; rs886043986; rs2161037 |
| 168 | ABCB11; DHRS9; rs886043986; rs2161037 |
| 169 | PUM2; rs111612372 |
| 170 | PUM2; rs111612372 |
| 171 | PUM2; rs585017 |
| 172 | PUM2; rs585017 |
| 173 | TBX18; rs869320679; rs797045022; rs77693245 |
| 174 | TBX18; rs869320679; rs797045022; rs77693245 |
| 175 | ST18; rs2360806 |
| 176 | ST18; rs2360806 |
| 177 | ARMC1; MTFR1; rs6991838 |
| 178 | ARMC1; MTFR1; rs6991838 |
| 179 | ANKRD18A; CNTNAP3 |
| 180 | ANKRD18A; CNTNAP3 |
| 181 | CREB5; rs56388170 |
| 182 | CREB5; rs56388170 |
| 183 | ELMO1; rs6942726; rs17170851 |
| 184 | ELMO1; rs6942726; rs17170851 |
| 185 | LRRTM4; rs61354037 |
| 186 | LRRTM4; rs61354037 |
| 187 | rs1998013; rs10888935 |
| 188 | rs1998013; rs10888935 |
| 189 | DNAH7; SLC39A10 |
| 190 | DNAH7; SLC39A10 |
| 191 | BAG1; CHMP5; NFX1 |
| 192 | BAG1; CHMP5; NFX1 |
| 193 | EML4; rs17029233 |
| 194 | EML4; rs17029233 |
| 195 | ADCY1; rs1294908 |
| 196 | ADCY1; rs1294908 |
| 197 | NR2F2; rs587777373; rs2398180 |
| 198 | NR2F2; rs587777373; rs2398180 |

TABLE 1.c9-continued

| | Gene |
|---|---|
| 199 | PIP4K2A; rs1409395; rs370356098 |
| 200 | PIP4K2A; rs1409395; rs370356098 |
| 201 | PLCL1; rs7587251; rs6745726; rs1368989; rs12105927; rs7590828; rs1866666; rs1036333; rs2164068; rs1064213; rs11684176 |
| 202 | PLCL1; rs7587251; rs6745726; rs1368989; rs12105927; rs7590828; rs1866666; rs1036333; rs2164068; rs1064213; rs11684176 |
| 203 | C10orf11; rs10509373; rs11593840 |
| 204 | C10orf11; rs10509373; rs11593840 |
| 205 | MEIS1; rs10865355; rs11897119; rs2300478; rs2300481 |
| 206 | MEIS1; rs10865355; rs11897119; rs2300478; rs2300481 |
| 207 | MSRA; rs73191547; rs10087178; rs10107815 |
| 208 | MSRA; rs73191547; rs10087178; rs10107815 |
| 209 | ARMC1; rs6991838 |
| 210 | ARMC1; rs6991838 |
| 211 | rs2337406; rs11846409 |
| 212 | rs2337406; rs11846409 |

TABLE 1.d1

| | Probe | GeneLocus |
|---|---|---|
| 213 | ORF152_14_106693397_106698909_106739902_106745380_RR | rs2337406; rs11846409 |
| 214 | ORF152_14_106693397_106698909_106739902_106745380_RR | rs2337406; rs11846409 |
| 215 | ORF153_3_65835051_65839403_65898255_65903690_FF | MAGI1; rs145965284 |
| 216 | ORF153_3_65835051_65839403_65898255_65903690_FF | MAGI1; rs145965284 |
| 217 | ORF153_7_131130568_131132000_131219450_131221740_RR | MKLN1; rs114034759 |
| 218 | ORF153_7_131130568_131132000_131219450_131221740_RR | MKLN1; rs114034759 |
| 219 | ORF154_6_73688989_73690148_73751804_73758297_FF | CD109; SLC17A5 |
| 220 | ORF154_6_73688989_73690148_73751804_73758297_FF | CD109; SLC17A5 |
| 221 | ORF155_18_3106299_3108561_3129940_3131675_RR | MYOM1; rs751200138 |
| 222 | ORF155_18_3106299_3108561_3129940_3131675_RR | MYOM1; rs751200138 |
| 223 | ORF155_5_36136424_36142007_36160830_36164969_FF | LMBRD2; SKP2; rs2270909; rs12657634; rs10941274; rs12655052; rs3804446 |
| 224 | ORF155_5_36136424_36142007_36160830_36164969_FF | LMBRD2; SKP2; rs2270909; rs12657634; rs10941274; rs12655052; rs3804446 |
| 225 | ORF158_5_26999889_27004744_27042244_27044606_RF | CDH9; rs201058683 |
| 226 | ORF158_5_26999889_27004744_27042244_27044606_RF | CDH9; rs201058683 |
| 227 | ORF16_1_36409666_36411937_36433268_36434547_RR | LSM10; OSCP1 |
| 228 | ORF16_1_36409666_36411937_36433268_36434547_RR | LSM10; OSCP1 |
| 229 | ORF16_2_66446190_66449017_66470757_66475654_FR | MEIS1; rs11692361 |
| 230 | ORF16_2_66446190_66449017_66470757_66475654_FR | MEIS1; rs11692361 |
| 231 | ORF16_3_107626100_107637571_107708851_107713617_RR | BBX; rs11710737 |
| 232 | ORF16_3_107626100_107637571_107708851_107713617_RR | BBX; rs11710737 |
| 233 | ORF16_4_175829279_175833051_175892267_175894404_RR | GPM6A; rs1106568 |
| 234 | ORF16_4_175829279_175833051_175892267_175894404_RR | GPM6A; rs1106568 |

TABLE 1.d1-continued

| | Probe | GeneLocus |
|---|---|---|
| 235 | ORF16_5_6223946_6226870_6283431_6289065_FR | rs12518614 |
| 236 | ORF16_5_6223946_6226870_6283431_6289065_FR | rs12518614 |
| 237 | ORF16_8_52380368_52388099_52462030_52466077_RR | ST18; rs7820212 |
| 238 | ORF16_8_52380368_52388099_52462030_52466077_RR | ST18; rs7820212 |
| 239 | ORF16_8_67971637_67976278_68010294_68014710_RR | PREX2; rs4512367 |
| 240 | ORF16_8_67971637_67976278_68010294_68014710_RR | PREX2; rs4512367 |
| 241 | ORF16_9_38681931_38686861_38768696_38769724_FR | ANKRD18A; CNTNAP3 |
| 242 | ORF16_9_38681931_38686861_38768696_38769724_FR | ANKRD18A; CNTNAP3 |
| 243 | ORF160_5_93562856_93565579_93582366_93583770_FF | NR2F1; rs587777277 |
| 244 | ORF160_5_93562856_93565579_93582366_93583770_FF | NR2F1; rs587777277 |
| 245 | ORF162_14_51804670_51807147_51886119_51892276_RF | FRMD6; GNG2; rs8015138 |
| 246 | ORF162_14_51804670_51807147_51886119_51892276_RF | FRMD6; GNG2; rs8015138 |
| 247 | ORF162_6_146094504_146104695_146155392_146161780_RR | GRM1; SHPRH |
| 248 | ORF162_6_146094504_146104695_146155392_146161780_RR | GRM1; SHPRH |
| 249 | ORF163_19_36775089_36776260_36803032_36806792_FR | ZNF790; ZNF850 |
| 250 | ORF163_19_36775089_36776260_36803032_36806792_FR | ZNF790; ZNF850 |
| 251 | ORF164_1_229859020_229862315_229908605_229911291_RF | GALNT2; rs4925506 |
| 252 | ORF164_1_229859020_229862315_229908605_229911291_RF | GALNT2; rs4925506 |
| 253 | ORF164_7_45364155_45370311_45384350_45391053_FF | ADCY1; rs1294908 |
| 254 | ORF164_7_45364155_45370311_45384350_45391053_FF | ADCY1; rs1294908 |
| 255 | ORF166_12_130196441_130198032_130248318_130252496_FF | FZD10; PIWIL1 |
| 256 | ORF166_12_130196441_130198032_130248318_130252496_FF | FZD10; PIWIL1 |
| 257 | ORF166_14_89880613_89884758_89952946_89954082_RR | EFCAB11; TDP1 |
| 258 | ORF166_14_89880613_89884758_89952946_89954082_RR | EFCAB11; TDP1 |
| 259 | ORF169_1_206307932_206310423_206383244_206385305_FF | SRGAP2; rs2987927 |
| 260 | ORF169_1_206307932_206310423_206383244_206385305_FF | SRGAP2; rs2987927 |
| 261 | ORF17_1_76086337_76098934_76123667_76127663_FF | ST6GALNAC3; rs915404 |
| 262 | ORF17_1_76086337_76098934_76123667_76127663_FF | ST6GALNAC3; rs915404 |
| 263 | ORF17_11_128975846_128978309_129021767_129026895_FR | ARHGAP32; rs11221522 |
| 264 | ORF17_11_128975846_128978309_129021767_129026895_FR | ARHGAP32; rs11221522 |
| 265 | ORF17_2_78763526_78765449_78792347_78798562_FF | REG3G |
| 266 | ORF17_2_78763526_78765449_78792347_78798562_FF | REG3G |
| 267 | ORF17_21_17393292_17394472_17434190_17435748_RR | CXADR |
| 268 | ORF17_21_17393292_17394472_17434190_17435748_RR | CXADR |
| 269 | ORF17_4_37859966_37862832_37927829_37933173_FF | GAFA3; PGM2; PTTG2; TBC1D1; rs17578878; rs35859249 |
| 270 | ORF17_4_37859966_37862832_37927829_37933173_FF | GAFA3; PGM2; PTTG2; TBC1D1; rs17578878; rs35859249 |
| 271 | ORF17_7_23187280_23192079_23219086_23222886_FR | NUPL2; rs858249 |
| 272 | ORF17_7_23187280_23192079_23219086_23222886_FR | NUPL2; rs858249 |

TABLE 1.d1-continued

| | Probe | GeneLocus |
|---|---|---|
| 273 | ORF17_8_65560550_65562514_65630980_65632323_FR | ARMC1; rs6991838 |
| 274 | ORF17_8_65560550_65562514_65630980_65632323_FR | ARMC1; rs6991838 |
| 275 | ORF17_8_88542085_88553888_88592759_88597112_RF | rs10504861; rs7838490; rs7819570; rs11995572 |
| 276 | ORF17_8_88542085_88553888_88592759_88597112_RF | rs10504861; rs7838490; rs7819570; rs11995572 |
| 277 | ORF170_2_56323476_56329636_56390760_56394124_FF | CCDC85A; rs186920977; rs6747380; rs17268785 |
| 278 | ORF170_2_56323476_56329636_56390760_56394124_FF | CCDC85A; rs186920977; rs6747380; rs17268785 |
| 279 | ORF171_3_63280859_63282281_63308360_63313318_FR | SYNPR; rs13098482 |
| 280 | ORF171_3_63280859_63282281_63308360_63313318_FR | SYNPR; rs13098482 |
| 281 | ORF171_8_27764811_27768513_27798255_27800731_RF | CCDC25; ESCO2; rs80359869; rs80359844; rs80359845; rs80359846; rs80359847; rs80359848; rs80359849; rs80359850; rs80359851; rs80359852; rs80359853; rs80359854; rs80359855; rs80359856; rs80359857; rs797045565; rs797045566; rs80359858; rs80359859; rs80359861; rs80359862; rs146312522; rs80359863; rs80359864; rs80359865; rs80359866; rs80359867; rs80359868 |
| 282 | ORF171_8_27764811_27768513_27798255_27800731_RF | CCDC25; ESCO2; rs80359869; rs80359844; rs80359845; rs80359846; rs80359847; rs80359848; rs80359849; rs80359850; rs80359851; rs80359852; rs80359853; rs80359854; rs80359855; rs80359856; rs80359857; rs797045565; rs797045566; rs80359858; rs80359859; rs80359861; rs80359862; rs146312522; rs80359863; rs80359864; rs80359865; rs80359866; rs80359867; rs80359868 |
| 283 | ORF173_8_113409304_113413871_113438847_113446082_FF | CSMD3; rs189590409 |
| 284 | ORF173_8_113409304_113413871_113438847_113446082_FF | CSMD3; rs189590409 |
| 285 | ORF176_12_96187243_96188661_96237099_96241349_RF | CDK17; ELK3; rs4762284 |
| 286 | ORF176_12_96187243_96188661_96237099_96241349_RF | CDK17; ELK3; rs4762284 |

TABLE 1.d2

| | Probe_Count_Total | Probe_Count_Sig | HyperG_Stats |
|---|---|---|---|
| 213 | NA | NA | NA |
| 214 | NA | NA | NA |
| 215 | 55 | 5; 5 | 0.042810093; 0.05348201 |
| 216 | 55 | 5; 5 | 0.042810093; 0.05348201 |
| 217 | 121 | 1; 1 | 0.039588815; 0.028906509 |
| 218 | 121 | 1; 1 | 0.039588815; 0.028906509 |
| 219 | 34; 34 | 3; 3; 3; 3 | 0.103367502; 0.117734198; 0.103367502; 0.117734198 |
| 220 | 34; 34 | 3; 3; 3; 3 | 0.103367502; 0.117734198; 0.103367502; 0.117734198 |
| 221 | 13 | 1; 1 | 0.314642613; 0.32680192 |
| 222 | 13 | 1; 1 | 0.314642613; 0.32680192 |
| 223 | 16; 16 | 1; 2; 1; 2 | 0.343724359; 0.116490918; 0.343724359; 0.116490918 |

TABLE 1.d2-continued

| | Probe_Count_Total | Probe_Count_Sig | HyperG_Stats |
|---|---|---|---|
| 224 | 16; 16 | 1; 2; 1; 2 | 0.343724359; 0.116490918; 0.343724359; 0.116490918 |
| 225 | 30 | 3; 1 | 0.082195447; 0.363021342 |
| 226 | 30 | 3; 1 | 0.082195447; 0.363021342 |
| 227 | 124; 112 | 3; 3; 3; 3 | 0.149414204; 0.126913559; 0.17713842; 0.156487188 |
| 228 | 124; 112 | 3; 3; 3; 3 | 0.149414204; 0.126913559; 0.17713842; 0.156487188 |
| 229 | 57 | 4; 2 | 0.110951788; 0.26588291 |
| 230 | 57 | 4; 2 | 0.110951788; 0.26588291 |
| 231 | 30 | 4; 5 | 0.022454364; 0.006393518 |
| 232 | 30 | 4; 5 | 0.022454364; 0.006393518 |
| 233 | 68 | 3; 4 | 0.224345313; 0.163371308 |
| 234 | 68 | 3; 4 | 0.224345313; 0.163371308 |
| 235 | NA | NA | NA |
| 236 | NA | NA | NA |
| 237 | 78 | 2; 4 | 0.222357541; 0.186212358 |
| 238 | 78 | 2; 4 | 0.222357541; 0.186212358 |
| 239 | 10 | 1; 1 | 0.272678156; 0.285987033 |
| 240 | 10 | 1; 1 | 0.272678156; 0.285987033 |
| 241 | 21; 8 | 8; 8; 8; 8 | 6.3e−07; 1.12e−06; 5.16e−12; 9.55e−12 |
| 242 | 21; 8 | 8; 8; 8; 8 | 6.3e−07; 1.12e−06; 5.16e−12; 9.55e−12 |
| 243 | 20 | 1; 2 | 0.366490901; 0.155331399 |
| 244 | 20 | 1; 2 | 0.366490901; 0.155331399 |
| 245 | 13; 36 | 1; 1; 2; 3 | 0.314642613; 0.32680192; 0.247980559; 0.12891994 |
| 246 | 13; 36 | 1; 1; 2; 3 | 0.314642613; 0.32680192; 0.247980559; 0.12891994 |
| 247 | 28; 28 | 1; 2; 1; 2 | 0.373281001; 0.219149094; 0.373281001; 0.219149094 |
| 248 | 28; 28 | 1; 2; 1; 2 | 0.373281001; 0.219149094; 0.373281001; 0.219149094 |
| 249 | 7; 12 | 1; 1; 1; 1 | 0.215038813; 0.227740664; 0.302214299; 0.314913912 |
| 250 | 7; 12 | 1; 1; 1; 1 | 0.215038813; 0.227740664; 0.302214299; 0.314913912 |
| 251 | 44 | 4; 3 | 0.063857117; 0.169607427 |
| 252 | 44 | 4; 3 | 0.063857117; 0.169607427 |
| 253 | 30 | 2; 2 | 0.21731878; 0.231426351 |
| 254 | 30 | 2; 2 | 0.21731878; 0.231426351 |
| 255 | 52; 88 | 1; 1; 1; 1 | 0.266738689; 0.244043749; 0.107508983; 0.08745761 |
| 256 | 52; 88 | 1; 1; 1; 1 | 0.266738689; 0.244043749; 0.107508983; 0.08745761 |
| 257 | 81; 71 | 1; 2; 1; 2 | 0.130826821; 0.192025586; 0.170848338; 0.226583412 |
| 258 | 81; 71 | 1; 2; 1; 2 | 0.130826821; 0.192025586; 0.170848338; 0.226583412 |
| 259 | 41 | 2; 2 | 0.26460109; 0.271883499 |
| 260 | 41 | 2; 2 | 0.26460109; 0.271883499 |
| 261 | 45 | 5; 5 | 0.022343156; 0.028833151 |
| 262 | 45 | 5; 5 | 0.022343156; 0.028833151 |
| 263 | 3 | 1; 1 | 0.108032075; 0.115907508 |
| 264 | 3 | 1; 1 | 0.108032075; 0.115907508 |
| 265 | 3 | 3; 2 | 0; 0.001770535 |
| 266 | 3 | 3; 2 | 0; 0.001770535 |
| 267 | 45 | 6; 1 | 0.006017292; 0.285503815 |
| 268 | 45 | 6; 1 | 0.006017292; 0.285503815 |
| 269 | 37; 37; 16; 40 | 5; 8; 5; 8; 1; 2; 2; 3 | 0.010942367; 0.000107113; 0.010942367; 0.000107113; 0.343724359; 0.116490918; 0.261899069; 0.150241062 |
| 270 | 37; 37; 16; 40 | 5; 8; 5; 8; 1; 2; 2; 3 | 0.010942367; 0.000107113; 0.010942367; 0.000107113; 0.343724359; 0.116490918; 0.261899069; 0.150241062 |
| 271 | 51 | 1; 1 | 0.272236181; 0.249886334 |
| 272 | 51 | 1; 1 | 0.272236181; 0.249886334 |
| 273 | 48 | 5; 4 | 0.02780594; 0.092112824 |
| 274 | 48 | 5; 4 | 0.02780594; 0.092112824 |
| 275 | NA | NA | NA |
| 276 | NA | NA | NA |
| 277 | 35 | 4; 2 | 0.035189793; 0.255336195 |
| 278 | 35 | 4; 2 | 0.035189793; 0.255336195 |
| 279 | 41 | 2; 1 | 0.26460109; 0.309016356 |
| 280 | 41 | 2; 1 | 0.26460109; 0.309016356 |

TABLE 1.d2-continued

| | Probe_Count_Total | Probe_Count_Sig | HyperG_Stats |
|---|---|---|---|
| 281 | 64; 45 | 1; 1; 1; 1 | 0.203553997; 0.179089876; 0.305019886; 0.285503815 |
| 282 | 64; 45 | 1; 1; 1; 1 | 0.203553997; 0.179089876; 0.305019886; 0.285503815 |
| 283 | 12 | 1; 2 | 0.302214299; 0.076075379 |
| 284 | 12 | 1; 2 | 0.302214299; 0.076075379 |
| 285 | 13; 13 | 1; 1; 2; 3 | 0.314642613; 0.32680192; 0.076537269; 0.013853987 |
| 286 | 13; 13 | 1; 1; 2; 3 | 0.314642613; 0.32680192; 0.076537269; 0.013853987 |

TABLE 1.d3

| | FDR_HyperG | Percent_Sig | logFC | AveExpr |
|---|---|---|---|---|
| 213 | NA | NA | 0.555765552 | 0.555765552 |
| 214 | NA | NA | 0.492575943 | 0.492575943 |
| 215 | 0.375519541; 0.376115439 | 9.09; 9.09 | 0.984216332 | 0.984216332 |
| 216 | 0.375519541; 0.376115439 | 9.09; 9.09 | 0.904733665 | 0.904733665 |
| 217 | 0.375519541; 0.376115439 | 0.83; 0.83 | 0.679292964 | 0.679292964 |
| 218 | 0.375519541; 0.376115439 | 0.83; 0.83 | 0.675599569 | 0.675599569 |
| 219 | 0.375519541; 0.376115439; 0.375519541; 0.376115439 | 8.82; 8.82; 8.82; 8.82 | 0.631496413 | 0.631496413 |
| 220 | 0.375519541; 0.376115439; 0.375519541; 0.376115439 | 8.82; 8.82; 8.82; 8.82 | 0.624545129 | 0.624545129 |
| 221 | 0.375519541; 0.376115439 | 7.69; 7.69 | 0.686983289 | 0.686983289 |
| 222 | 0.375519541; 0.376115439 | 7.69; 7.69 | 0.655999636 | 0.655999636 |
| 223 | 0.375519541; 0.376115439; 0.375519541; 0.376115439 | 6.25; 12.5; 6.25; 12.5 | 0.70992284 | 0.70992284 |
| 224 | 0.375519541; 0.376115439; 0.375519541; 0.376115439 | 6.25; 12.5; 6.25; 12.5 | 0.685092872 | 0.685092872 |
| 225 | 0.375519541; 0.376115439 | 10; 3.33 | 0.579134595 | 0.579134595 |
| 226 | 0.375519541; 0.376115439 | 10; 3.33 | 0.525435803 | 0.525435803 |
| 227 | 0.375519541; 0.376115439; 0.375519541; 0.376115439 | 2.42; 2.42; 2.68; 2.68 | 0.583374913 | 0.583374913 |
| 228 | 0.375519541; 0.376115439; 0.375519541; 0.376115439 | 2.42; 2.42; 2.68; 2.68 | 0.546729205 | 0.546729205 |
| 229 | 0.375519541; 0.376115439 | 7.02; 3.51 | 1.050848942 | 1.050848942 |
| 230 | 0.375519541; 0.376115439 | 7.02; 3.51 | 0.997588794 | 0.997588794 |
| 231 | 0.375519541; 0.217379602 | 13.33; 16.67 | 0.718226025 | 0.718226025 |
| 232 | 0.375519541; 0.217379602 | 13.33; 16.67 | 0.518370475 | 0.518370475 |
| 233 | 0.375519541; 0.376115439 | 4.41; 5.88 | 0.587276619 | 0.587276619 |
| 234 | 0.375519541; 0.376115439 | 4.41; 5.88 | 0.553712202 | 0.553712202 |
| 235 | NA | NA | 0.528734129 | 0.528734129 |
| 236 | NA | NA | 0.519765114 | 0.519765114 |
| 237 | 0.375519541; 0.376115439 | 2.56; 5.13 | 0.657404682 | 0.657404682 |
| 238 | 0.375519541; 0.376115439 | 2.56; 5.13 | 0.652559324 | 0.652559324 |
| 239 | 0.375519541; 0.376115439 | 10; 10 | 0.615586809 | 0.615586809 |
| 240 | 0.375519541; 0.376115439 | 10; 10 | 0.562580238 | 0.562580238 |
| 241 | 0.000109745; 0.00028483; 1.35e−09; 4.87e−09 | 38.1; 38.1; 100; 100 | 0.755371177 | 0.755371177 |
| 242 | 0.000109745; 0.00028483; 1.35e−09; 4.87e−09 | 38.1; 38.1; 100; 100 | 0.610723495 | 0.610723495 |
| 243 | 0.375519541; 0.376115439 | 5; 10 | 0.726687643 | 0.726687643 |
| 244 | 0.375519541; 0.376115439 | 5; 10 | 0.684934753 | 0.684934753 |
| 245 | 0.375519541; 0.376115439; 0.375519541; 0.376115439 | 7.69; 7.69; 5.56; 8.33 | 0.592746388 | 0.592746388 |
| 246 | 0.375519541; 0.376115439; 0.375519541; 0.376115439 | 7.69; 7.69; 5.56; 8.33 | 0.50869677 | 0.50869677 |
| 247 | 0.375519541; 0.376115439; 0.375519541; 0.376115439 | 3.57; 7.14; 3.57; 7.14 | 0.57957564 | 0.57957564 |
| 248 | 0.375519541; 0.376115439; 0.375519541; 0.376115439 | 3.57; 7.14; 3.57; 7.14 | 0.569686123 | 0.569686123 |

TABLE 1.d3-continued

| | FDR_HyperG | Percent_Sig | logFC | AveExpr |
|---|---|---|---|---|
| 249 | 0.375519541; 0.376115439; 0.375519541; 0.376115439 | 14.29; 14.29; 8.33; 8.33 | 0.731224565 | 0.731224565 |
| 250 | 0.375519541; 0.376115439; 0.375519541; 0.376115439 | 14.29; 14.29; 8.33; 8.33 | 0.634525197 | 0.634525197 |
| 251 | 0.375519541; 0.376115439 | 9.09; 6.82 | 0.60784154 | 0.60784154 |
| 252 | 0.375519541; 0.376115439 | 9.09; 6.82 | 0.521330725 | 0.521330725 |
| 253 | 0.375519541; 0.376115439 | 6.67; 6.67 | 0.913741587 | 0.913741587 |
| 254 | 0.375519541; 0.376115439 | 6.67; 6.67 | 0.742478856 | 0.742478856 |
| 255 | 0.375519541; 0.376115439; 0.375519541; 0.376115439 | 1.92; 1.92; 1.14; 1.14 | 0.968228342 | 0.968228342 |
| 256 | 0.375519541; 0.376115439; 0.375519541; 0.376115439 | 1.92; 1.92; 1.14; 1.14 | 0.860213569 | 0.860213569 |
| 257 | 0.375519541; 0.376115439; 0.375519541; 0.376115439 | 1.23; 2.47; 1.41; 2.82 | 0.63321845 | 0.63321845 |
| 258 | 0.375519541; 0.376115439; 0.375519541; 0.376115439 | 1.23; 2.47; 1.41; 2.82 | 0.620644012 | 0.620644012 |
| 259 | 0.375519541; 0.376115439 | 4.88; 4.88 | 0.687605502 | 0.687605502 |
| 260 | 0.375519541; 0.376115439 | 4.88; 4.88 | 0.672032414 | 0.672032414 |
| 261 | 0.375519541; 0.376115439 | 11.11; 11.11 | 0.727600901 | 0.727600901 |
| 262 | 0.375519541; 0.376115439 | 11.11; 11.11 | 0.657100455 | 0.657100455 |
| 263 | 0.375519541; 0.376115439 | 33.33; 33.33 | 0.716018427 | 0.716018427 |
| 264 | 0.375519541; 0.376115439 | 33.33; 33.33 | 0.648215413 | 0.648215413 |
| 265 | 0; 0.082088441 | 100; 100 | 0.608572853 | 0.608572853 |
| 266 | 0; 0.082088441 | 100; 100 | 0.581521773 | 0.581521773 |
| 267 | 0.242080288; 0.376115439 | 13.33; 2.22 | 0.784915067 | 0.784915067 |
| 268 | 0.242080288; 0.376115439 | 13.33; 2.22 | 0.643748555 | 0.643748555 |
| 269 | 0.357678624; 0.013656923; 0.357678624; 0.013656923; 0.375519541; 0.376115439 | 13.51; 21.62; 13.51; 21.62; 6.25; 12.5; 5; 7.5 | 0.732003297 | 0.732003297 |
| 270 | 0.357678624; 0.013656923; 0.357678624; 0.013656923; 0.375519541; 0.376115439 | 13.51; 21.62; 13.51; 21.62; 6.25; 12.5; 5; 7.5 | 0.59203768 | 0.59203768 |
| 271 | 0.375519541; 0.376115439 | 1.96; 1.96 | 0.837432144 | 0.837432144 |
| 272 | 0.375519541; 0.376115439 | 1.96; 1.96 | 0.75493067 | 0.75493067 |
| 273 | 0.375519541; 0.376115439 | 10.42; 8.33 | 0.78755073 | 0.78755073 |
| 274 | 0.375519541; 0.376115439 | 10.42; 8.33 | 0.702870259 | 0.702870259 |
| 275 | NA | NA | 1.046784237 | 1.046784237 |
| 276 | NA | NA | 0.973096611 | 0.973096611 |
| 277 | 0.375519541; 0.376115439 | 11.43; 5.71 | 0.623032467 | 0.623032467 |
| 278 | 0.375519541; 0.376115439 | 11.43; 5.71 | 0.513312306 | 0.513312306 |
| 279 | 0.375519541; 0.376115439 | 4.88; 2.44 | 0.715626316 | 0.715626316 |
| 280 | 0.375519541; 0.376115439 | 4.88; 2.44 | 0.653108277 | 0.653108277 |
| 281 | 0.375519541; 0.376115439; 0.375519541; 0.376115439 | 1.56; 1.56; 2.22; 2.22 | 0.542949491 | 0.542949491 |
| 282 | 0.375519541; 0.376115439; 0.375519541; 0.376115439 | 1.56; 1.56; 2.22; 2.22 | 0.541851946 | 0.541851946 |
| 283 | 0.375519541; 0.376115439 | 8.33; 16.67 | 0.64477187 | 0.64477187 |
| 284 | 0.375519541; 0.376115439 | 8.33; 16.67 | 0.525770097 | 0.525770097 |
| 285 | 0.375519541; 0.376115439; 0.375519541; 0.376115439 | 7.69; 7.69; 15.38; 23.08 | 0.711747903 | 0.711747903 |
| 286 | 0.375519541; 0.376115439; 0.375519541; 0.376115439 | 7.69; 7.69; 15.38; 23.08 | 0.691863386 | 0.691863386 |

TABLE 1.d4

| | T | P. Value | adj. P. Val | B | FC | FC_1 | LS |
|---|---|---|---|---|---|---|---|
| 213 | 7.260165345 | 0.0000103 | 0.00032205 | 3.676586181 | 1.46994844 | 1.46994844 | 1 |

TABLE 1.d4-continued

| | T | P. Value | adj. P. Val | B | FC | FC_1 | LS |
|---|---|---|---|---|---|---|---|
| 214 | 5.339439015 | 0.000177541 | 0.001246386 | 0.664445729 | 1.406954763 | 1.406954763 | 1 |
| 215 | 16.23202167 | 0.00000000169 | 0.00000233 | 12.26654232 | 1.978238447 | 1.978238447 | 1 |
| 216 | 14.18093827 | 0.00000000751 | 0.00000251 | 10.90523174 | 1.872198837 | 1.872198837 | 1 |
| 217 | 11.80434759 | 0.0000000613 | 0.0000138 | 8.841672429 | 1.601354771 | 1.601354771 | 1 |
| 218 | 12.02061316 | 0.0000000482 | 0.00000654 | 9.072614972 | 1.597260439 | 1.597260439 | 1 |
| 219 | 10.02330272 | 0.000000354 | 0.0000209 | 7.064564936 | 1.549171014 | 1.549171014 | 1 |
| 220 | 9.704432552 | 0.000000517 | 0.0000497 | 6.719924741 | 1.541724654 | 1.541724654 | 1 |
| 221 | 19.221459 | 0.000000000240 | 0.00000103 | 14.01108919 | 1.609913627 | 1.609913627 | 1 |
| 222 | 11.9389033 | 0.000000052 | 0.00000676 | 8.996907807 | 1.575707374 | 1.575707374 | 1 |
| 223 | 18.5672982 | 0.000000000359 | 0.00000126 | 13.66014624 | 1.635716631 | 1.635716631 | 1 |
| 224 | 15.02118219 | 0.00000000390 | 0.00000178 | 11.53971631 | 1.607805479 | 1.607805479 | 1 |
| 225 | 10.45337524 | 0.000000232 | 0.0000309 | 7.522312852 | 1.493952827 | 1.493952827 | 1 |
| 226 | 5.727638406 | 0.0000955 | 0.000800788 | 1.305056222 | 1.439368313 | 1.439368313 | 1 |
| 227 | 13.09171547 | 0.0000000185 | 0.00000396 | 10.02014744 | 1.49835026 | 1.49835026 | 1 |
| 228 | 15.57027442 | 0.00000000272 | 0.00000287 | 11.82659932 | 1.460770165 | 1.460770165 | 1 |
| 229 | 17.46312676 | 0.000000000729 | 0.00000168 | 13.03019046 | 2.071748592 | 2.071748592 | 1 |
| 230 | 19.47078279 | 0.000000000195 | 0.000000498 | 14.33533501 | 1.996660151 | 1.996660151 | 1 |
| 231 | 10.18859459 | 0.000000306 | 0.0000364 | 7.244811857 | 1.645157862 | 1.645157862 | 1 |
| 232 | 7.424246798 | 0.00000808 | 0.000150679 | 3.857176398 | 1.432336509 | 1.432336509 | 1 |
| 233 | 9.162816338 | 0.000000951 | 0.0000719 | 6.104525201 | 1.502407967 | 1.502407967 | 1 |
| 234 | 9.514869484 | 0.000000619 | 0.0000296 | 6.495454048 | 1.467857789 | 1.467857789 | 1 |
| 235 | 9.57959508 | 0.000000576 | 0.0000283 | 6.569345699 | 1.442662798 | 1.442662798 | 1 |
| 236 | 5.872975811 | 0.0000773 | 0.001227022 | 1.607969852 | 1.433721804 | 1.433721804 | 1 |
| 237 | 12.8429881 | 0.000000024 | 0.00000869 | 9.757379266 | 1.577242709 | 1.577242709 | 1 |
| 238 | 14.62271022 | 0.00000000530 | 0.00000212 | 11.24377521 | 1.571954352 | 1.571954352 | 1 |
| 239 | 2.726005115 | 0.018424033 | 0.04224655 | −4.03847984 | 1.532181078 | 1.532181078 | 1 |
| 240 | 9.344586893 | 0.000000773 | 0.0000634 | 6.314497427 | 1.476908285 | 1.476908285 | 1 |
| 241 | 5.878256372 | 0.0000766 | 0.001219955 | 1.616360692 | 1.688065842 | 1.688065842 | 1 |
| 242 | 6.610580495 | 0.0000252 | 0.000320602 | 2.6830041 | 1.527024802 | 1.527024802 | 1 |
| 243 | 15.96846986 | 0.00000000204 | 0.00000251 | 12.09392263 | 1.654835306 | 1.654835306 | 1 |
| 244 | 12.97764894 | 0.0000000205 | 0.00000415 | 9.92304991 | 1.607629273 | 1.607629273 | 1 |
| 245 | 14.16069263 | 0.00000000799 | 0.00000491 | 10.81250789 | 1.508114941 | 1.508114941 | 1 |
| 246 | 10.13226105 | 0.000000315 | 0.0000195 | 7.183226122 | 1.422764389 | 1.422764389 | 1 |
| 247 | 12.12472668 | 0.0000000455 | 0.000012 | 9.132672207 | 1.494409613 | 1.494409613 | 1 |
| 248 | 6.558598076 | 0.0000272 | 0.000336042 | 2.604916707 | 1.484200628 | 1.484200628 | 1 |
| 249 | 14.28865646 | 0.00000000721 | 0.00000475 | 10.90919894 | 1.660047548 | 1.660047548 | 1 |
| 250 | 12.23181776 | 0.0000000397 | 0.00000589 | 9.265978503 | 1.552426749 | 1.552426749 | 1 |
| 251 | 9.36635516 | 0.000000732 | 0.000033 | 6.324274905 | 1.523977434 | 1.523977434 | 1 |
| 252 | 9.435204652 | 0.000000697 | 0.0000594 | 6.417862317 | 1.435278522 | 1.435278522 | 1 |
| 253 | 13.53412308 | 0.0000000133 | 0.00000636 | 10.3246933 | 1.883925072 | 1.883925072 | 1 |
| 254 | 13.06000286 | 0.0000000191 | 0.000004 | 9.993240024 | 1.673048022 | 1.673048022 | 1 |
| 255 | 9.932830648 | 0.000000403 | 0.0000425 | 6.970408871 | 1.956436576 | 1.956436576 | 1 |
| 256 | 11.97244336 | 0.0000000504 | 0.00000668 | 9.028045246 | 1.815307019 | 1.815307019 | 1 |
| 257 | 13.38530727 | 0.0000000151 | 0.00000688 | 10.20520537 | 1.551021248 | 1.551021248 | 1 |
| 258 | 16.21810555 | 0.00000000162 | 0.00000118 | 12.3786542 | 1.537561388 | 1.537561388 | 1 |
| 259 | 13.08809821 | 0.0000000194 | 0.00000782 | 9.96222989 | 1.610608109 | 1.610608109 | 1 |
| 260 | 17.49673479 | 0.000000000675 | 0.000000801 | 13.19969713 | 1.59331599 | 1.59331599 | 1 |
| 261 | 11.3234876 | 0.0000000934 | 0.00000943 | 8.40997782 | 1.655883186 | 1.655883186 | 1 |
| 262 | 10.33956834 | 0.000000261 | 0.0000331 | 7.403844592 | 1.576910145 | 1.576910145 | 1 |
| 263 | 13.37427123 | 0.0000000146 | 0.00000347 | 10.25695904 | 1.642642382 | 1.642642382 | 1 |
| 264 | 10.50748087 | 0.000000219 | 0.00003 | 7.578213938 | 1.567228364 | 1.567228364 | 1 |
| 265 | 13.60186555 | 0.000000012 | 0.00000309 | 10.44395365 | 1.524750145 | 1.524750145 | 1 |
| 266 | 11.90195534 | 0.0000000559 | 0.0000134 | 8.931166808 | 1.496426866 | 1.496426866 | 1 |
| 267 | 11.22011494 | 0.000000107 | 0.0000193 | 8.290092068 | 1.722990882 | 1.722990882 | 1 |
| 268 | 9.919790976 | 0.000000396 | 0.0000224 | 6.95077435 | 1.562383432 | 1.562383432 | 1 |
| 269 | 11.68690688 | 0.0000000684 | 0.0000148 | 8.73300385 | 1.660943844 | 1.660943844 | 1 |
| 270 | 12.30985713 | 0.000000037 | 0.00000569 | 9.336589654 | 1.507374278 | 1.507374278 | 1 |
| 271 | 14.15860604 | 0.00000000800 | 0.00000491 | 10.81092318 | 1.786866862 | 1.786866862 | 1 |
| 272 | 17.42726451 | 0.000000000707 | 0.000000818 | 13.15692781 | 1.687550493 | 1.687550493 | 1 |
| 273 | 11.35923764 | 0.0000000902 | 0.00000925 | 8.44490275 | 1.726141495 | 1.726141495 | 1 |
| 274 | 15.50537662 | 0.00000000285 | 0.00000294 | 11.7822691 | 1.627739982 | 1.627739982 | 1 |
| 275 | 6.671069956 | 0.0000235 | 0.000553643 | 2.831017554 | 2.065919783 | 2.065919783 | 1 |
| 276 | 9.939739376 | 0.000000387 | 0.000022 | 6.972784712 | 1.96304958 | 1.96304958 | 1 |
| 277 | 10.48658633 | 0.000000224 | 0.0000303 | 7.556657964 | 1.540109008 | 1.540109008 | 1 |
| 278 | 10.6808888 | 0.000000177 | 0.0000139 | 7.763842221 | 1.427323451 | 1.427323451 | 1 |
| 279 | 16.7420602 | 0.00000000112 | 0.000000998 | 12.72395428 | 1.642195988 | 1.642195988 | 1 |
| 280 | 17.0717273 | 0.000000000946 | 0.00000189 | 12.79475608 | 1.572552603 | 1.572552603 | 1 |
| 281 | 11.71698674 | 0.0000000665 | 0.0000146 | 8.760940678 | 1.456948105 | 1.456948105 | 1 |
| 282 | 19.31548313 | 0.000000000214 | 0.000000503 | 14.25125578 | 1.455840138 | 1.455840138 | 1 |
| 283 | 10.21192721 | 0.000000289 | 0.0000186 | 7.269270408 | 1.563492036 | 1.563492036 | 1 |
| 284 | 11.53933542 | 0.0000000787 | 0.0000162 | 8.59489991 | 1.439701874 | 1.439701874 | 1 |
| 285 | 11.4882289 | 0.0000000797 | 0.00000864 | 8.57005061 | 1.637787183 | 1.637787183 | 1 |
| 286 | 12.53535025 | 0.0000000314 | 0.00000988 | 9.494366239 | 1.615368583 | 1.615368583 | 1 |

TABLE 1.d5

| | Loop Detected | Probe sequence 60 mer | Probe Location Chr |
|---|---|---|---|
| 213 | mHC | TTTGTGTTTCATGACCTGCTAAATACTTTCGAAAGTATTTAGCAGGTCATGAAACACAAA (SEQ ID NO: 638) | 14 |
| 214 | sHC | TTTGTGTTTCATGACCTGCTAAATACTTTCGAAAGTATTTAGCAGGTCATGAAACACAAA (SEQ ID NO: 638) | 14 |
| 215 | mHC | TTATATCATTATTTTATAATGTATTCCTTCGAAATAAGCACTTAGGAAGTTTGAGTAAAT (SEQ ID NO: 640) | 3 |
| 216 | sHC | TTATATCATTATTTTATAATGTATTCCTTCGAAATAAGCACTTAGGAAGTTTGAGTAAAT (SEQ ID NO: 640) | 3 |
| 217 | mHC | TCTGTCATCTTCTTACGTATTAACATTATCGAATATTTGTGATTTGAAATTTGTCCTGGT (SEQ ID NO: 642) | 7 |
| 218 | sHC | TCTGTCATCTTCTTACGTATTAACATTATCGAATATTTGTGATTTGAAATTTGTCCTGGT (SEQ ID NO: 642) | 7 |
| 219 | sHC | TTTCTTGTATTTCATTATGTACATCTATTCGATAAAACTTTTTTTCTATAGTTCTCTGAC (SEQ ID NO: 644) | 6 |
| 220 | mHC | TTTCTTGTATTTCATTATGTACATCTATTCGATAAAACTTTTTTTCTATAGTTCTCTGAC (SEQ ID NO: 644) | 6 |
| 221 | mHC | GTTTCATTTCATATTTTCACAAAAGATCTCGAATTATGTGCAGTACTACAATAGTAATGG (SEQ ID NO: 646) | 18 |
| 222 | sHC | GTTTCATTTCATATTTTCACAAAAGATCTCGAATTATGTGCAGTACTACAATAGTAATGG (SEQ ID NO: 646) | 18 |
| 223 | mHC | AACATATATAAGCTTTTTACTTAAAAGTTCGATAATACTGTATTGTAGTCAGAATGTTTG (SEQ ID NO: 648) | 5 |
| 224 | sHC | AACATATATAAGCTTTTTACTTAAAAGTTCGATAATACTGTATTGTAGTCAGAATGTTTG (SEQ ID NO: 648) | 5 |
| 225 | mHC | CACTTAACAATATAATGTATAAATCTCCTCGAAGAAAATGCTGAAGAATATCTTAATGAC (SEQ ID NO: 650) | 5 |
| 226 | sHC | CACTTAACAATATAATGTATAAATCTCCTCGAAGAAAATGCTGAAGAATATCTTAATGAC (SEQ ID NO: 650) | 5 |
| 227 | sHC | TGGTAAATTGGAGCAGGTGACCTGGGAGTCGAGGCAGCTGCAGGATTTAAATTGGCTGAG (SEQ ID NO: 188) | 1 |
| 228 | mHC | TGGTAAATTGGAGCAGGTGACCTGGGAGTCGAGGCAGCTGCAGGATTTAAATTGGCTGAG (SEQ ID NO: 188) | 1 |
| 229 | mHC | CAAAGTACTACTTTAATTTATGACATAATCGAACACAGAAGTATTTATCTGAAAAGTGGA (SEQ ID NO: 654) | 2 |
| 230 | sHC | CAAAGTACTACTTTAATTTATGACATAATCGAACACAGAAGTATTTATCTGAAAAGTGGA (SEQ ID NO: 654) | 2 |
| 231 | mHC | TTTAAAATTGTTGACAGAAAATATATTATCGACATATATTTACCTACATAGAAGAGTATG (SEQ ID NO: 656) | 3 |
| 232 | sHC | TTTAAAATTGTTGACAGAAAATATATTATCGACATATATTTACCTACATAGAAGAGTATG (SEQ ID NO: 656) | 3 |
| 233 | mHC | ATATGATTATGGTTATAACTAAACTATATCGAACTTACTTCATTAACCTTAAAAAATACA (SEQ ID NO: 658) | 4 |
| 234 | sHC | ATATGATTATGGTTATAACTAAACTATATCGAACTTACTTCATTAACCTTAAAAAATACA (SEQ ID NO: 658) | 4 |
| 235 | sHC | TATCTAGATGTAGGTATATATTTATCTATCGACTTTCAAGCAAAGAAAATGCAAATATGC (SEQ ID NO: 660) | 5 |
| 236 | mHC | TATCTAGATGTAGGTATATATTTATCTATCGACTTTCAAGCAAAGAAAATGCAAATATGC (SEQ ID NO: 660) | 5 |
| 237 | mHC | CTGGAAGCCTTACAGATGACATAAACAATCGAATAAATAATGGAGCTAAATGGCATATAT (SEQ ID NO: 662) | 8 |
| 238 | sHC | CTGGAAGCCTTACAGATGACATAAACAATCGAATAAATAATGGAGCTAAATGGCATATAT | 8 |

TABLE 1.d5-continued

| Loop Detected | Probe sequence 60 mer | Probe Location Chr |
|---|---|---|
| | (SEQ ID NO: 662) | |
| 239 sHC | CTAATTTCATTTCTTTTTAGTTTCCTCTTCGATACCTTGAATTATAATACTTGTTCTGAT (SEQ ID NO: 664) | 8 |
| 240 mHC | CTAATTTCATTTCTTTTTAGTTTCCTCTTCGATACCTTGAATTATAATACTTGTTCTGAT (SEQ ID NO: 664) | 8 |
| 241 mHC | CCACGGAGGGGTCCTTCTGAACTGCAATTCGAGGTTCAGCACCGTAGGTGTAGCGCAGGC (SEQ ID NO: 666) | 9 |
| 242 sHC | CCACGGAGGGGTCCTTCTGAACTGCAATTCGAGGTTCAGCACCGTAGGTGTAGCGCAGGC (SEQ ID NO: 666) | 9 |
| 243 mHC | TTCAATTGTACTGTTAATATTTTATTTCTCGAATAAATAATCCTCTTCTTTTCCTCTTTC (SEQ ID NO: 668) | 5 |
| 244 sHC | TTCAATTGTACTGTTAATATTTTATTTCTCGAATAAATAATCCTCTTCTTTTCCTCTTTC (SEQ ID NO: 668) | 5 |
| 245 mHC | ATATGTAGATATATGTTTTCAAGCAATATCGAAGAGTAGTACCTTATCAAAGCTTTGCAG (SEQ ID NO: 670) | 14 |
| 246 sHC | ATATGTAGATATATGTTTTCAAGCAATATCGAAGAGTAGTACCTTATCAAAGCTTTGCAG (SEQ ID NO: 670) | 14 |
| 247 mHC | AATAGTATAATTAAAATAGTAAAGAAAATCGATATACCATAGGTGTATAGTAGGTTATGC (SEQ ID NO: 672) | 6 |
| 248 sHC | AATAGTATAATTAAAATAGTAAAGAAAATCGATATACCATAGGTGTATAGTAGGTTATGC (SEQ ID NO: 672) | 6 |
| 249 mHC | GTACATTTAATGAAACTACTAAAATATTTCGAATAGAAATACAATGCCAGACACATAAGT (SEQ ID NO: 674) | 19 |
| 250 sHC | GTACATTTAATGAAACTACTAAAATATTTCGAATAGAAATACAATGCCAGACACATAAGT (SEQ ID NO: 674) | 19 |
| 251 sHC | GATGATCAACATTCATTGAGAATGAAAATCGATTTATAACAAAAATAAACACTGTAGAAA (SEQ ID NO: 676) | 1 |
| 252 mHC | GATGATCAACATTCATTGAGAATGAAAATCGATTTATAACAAAAATAAACACTGTAGAAA (SEQ ID NO: 676) | 1 |
| 253 mHC | TTACTCACTTATTAGTCTATTAAGATTTTCGATATAAAACTTATAAATGGTTTATTTCTG (SEQ ID NO: 678) | 7 |
| 254 sHC | TTACTCACTTATTAGTCTATTAAGATTTTCGATATAAAACTTATAAATGGTTTATTTCTG (SEQ ID NO: 678) | 7 |
| 255 mHC | ACATATATATATATATTTAATATACATCGATAGATAATTGTCTTCCAGAATATTTTAA (SEQ ID NO: 680) | 12 |
| 256 sHC | ACATATATATATATATTTAATATACATCGATAGATAATTGTCTTCCAGAATATTTTAA (SEQ ID NO: 680) | 12 |
| 257 mHC | AATTAGTATTTATTTTTTCTATTTTATTTCGAATGAATGTAACAGGAAAGCAGAAAAGCA (SEQ ID NO: 682) | 14 |
| 258 sHC | AATTAGTATTTATTTTTTCTATTTTATTTCGAATGAATGTAACAGGAAAGCAGAAAAGCA (SEQ ID NO: 682) | 14 |
| 259 mHC | TTATTATAAATAAGTGTATATGTGAAATTCGATGTGTTTCTATTTTTAAAACCTCTTAAC (SEQ ID NO: 684) | 1 |
| 260 sHC | TTATTATAAATAAGTGTATATGTGAAATTCGATGTGTTTCTATTTTTAAAACCTCTTAAC (SEQ ID NO: 684) | 1 |
| 261 sHC | CCTTTCAAATTTAGATTTAAAATCTATTTCGATGCTACTAAAAGCAGCAATAATACTTTC (SEQ ID NO: 686) | 1 |
| 262 mHC | CCTTTCAAATTTAGATTTAAAATCTATTTCGATGCTACTAAAAGCAGCAATAATACTTTC (SEQ ID NO: 686) | 1 |
| 263 sHC | TTTAAACTATTTTTAAAAGAGTACTTTTTCGACTTGGTACAAAATCAAAGTAAGAAGTAT (SEQ ID NO: 688) | 11 |

TABLE 1.d5-continued

| | Loop Detected | Probe sequence 60 mer | Probe Location Chr |
|---|---|---|---|
| 264 | mHC | TTTAAACTATTTTTAAAAGAGTACTTTTTCGACTTGGTACAAAATCAAAGTAAGAAGTAT (SEQ ID NO: 688) | 11 |
| 265 | sHC | CTATATTGTAGCTCTATTTTCTCTAAATTCGAAGAATCATGCCTTAATGGATTGAAACAA (SEQ ID NO: 690) | 2 |
| 266 | mHC | CTATATTGTAGCTCTATTTTCTCTAAATTCGAAGAATCATGCCTTAATGGATTGAAACAA (SEQ ID NO: 690) | 2 |
| 267 | mHC | TTTTTATTTTATCTTTTATTTTATTTTTTCGAATTCATGTTTTTTCTCTTGGAATTTTCT (SEQ ID NO: 692) | 21 |
| 268 | sHC | TTTTTATTTTATCTTTTATTTTATTTTTTCGAATTCATGTTTTTTCTCTTGGAATTTTCT (SEQ ID NO: 692) | 21 |
| 269 | mHC | CCTACCAGAACTCTTAAATCTATAATATTCGAAATTTTATTATCTTAGGTGAGAAAATAG (SEQ ID NO: 694) | 4 |
| 270 | sHC | CCTACCAGAACTCTTAAATCTATAATATTCGAAATTTTATTATCTTAGGTGAGAAAATAG (SEQ ID NO: 694) | 4 |
| 271 | mHC | GTAACTACTACATTTTAGTATATTTCTTTCGATCAGAAGTTAACTCTAATTGAATCATAG (SEQ ID NO: 696) | 7 |
| 272 | sHC | GTAACTACTACATTTTAGTATATTTCTTTCGATCAGAAGTTAACTCTAATTGAATCATAG (SEQ ID NO: 696) | 7 |
| 273 | sHC | TATCTCTATGTAATAATCACTAAAAGTATCGATTCATGCTTGGTTGAATCAGACAATGTC (SEQ ID NO: 698) | 8 |
| 274 | mHC | TATCTCTATGTAATAATCACTAAAAGTATCGATTCATGCTTGGTTGAATCAGACAATGTC (SEQ ID NO: 698) | 8 |
| 275 | mHC | ATCTCATTTAACAAAAGATGAGTAAAAATCGATTTTTTAACGAATGTATCTGAAAATAGC (SEQ ID NO: 700) | 8 |
| 276 | sHC | ATCTCATTTAACAAAAGATGAGTAAAAATCGATTTTTTAACGAATGTATCTGAAAATAGC (SEQ ID NO: 700) | 8 |
| 277 | mHC | TCGCTTTTCTTATATAAAGGAACATTTCTCGAGTGGTAATGTACCAATCATTCATTGATT (SEQ ID NO: 702) | 2 |
| 278 | sHC | TCGCTTTTCTTATATAAAGGAACATTTCTCGAGTGGTAATGTACCAATCATTCATTGATT (SEQ ID NO: 702) | 2 |
| 279 | sHC | TTCTCATGTTTCTTTTTCTGACTAAATGTCGATTGAGATATAATTGACATAATAAATTAC (SEQ ID NO: 704) | 3 |
| 280 | mHC | TTCTCATGTTTCTTTTTCTGACTAAATGTCGATTGAGATATAATTGACATAATAAATTAC (SEQ ID NO: 704) | 3 |
| 281 | mHC | TCTGTGATTAATGGATAAATGTGATATATCGACAGCATTTACTATTCATGTTACTTCATT (SEQ ID NO: 706) | 8 |
| 282 | sHC | TCTGTGATTAATGGATAAATGTGATATATCGACAGCATTTACTATTCATGTTACTTCATT (SEQ ID NO: 706) | 8 |
| 283 | sHC | TTTATTTACCTTCTTGTATGAATATTGATCGAATCTCAACATCCTTAACATAGTTACATC (SEQ ID NO: 708) | 8 |
| 284 | mHC | TTTATTTACCTTCTTGTATGAATATTGATCGAATCTCAACATCCTTAACATAGTTACATC (SEQ ID NO: 708) | 8 |
| 285 | sHC | ATATGCTTTTTTTAAATTACAAAACTTATCGATCATTTTTTAAATTTAAAACTCTGAAGC (SEQ ID NO: 710) | 12 |
| 286 | mHC | ATATGCTTTTTTTAAATTACAAAACTTATCGATCATTTTTTAAATTTAAAACTCTGAAGC (SEQ ID NO: 710) | 12 |

TABLE 1.d6

| | Probe Location | | | | 4 kb Sequence Location | | | | |
|---|---|---|---|---|---|---|---|---|---|
| | Start1 | End1 | Start2 | End2 | Chr | Start1 | End1 | Start2 | End2 |
| 213 | 106693397 | 106693428 | 106739902 | 106739933 | 14 | 106693397 | 106697398 | 106739902 | 106743903 |
| 214 | 106693397 | 106693428 | 106739902 | 106739933 | 14 | 106693397 | 106697398 | 106739902 | 106743903 |
| 215 | 65839372 | 65839403 | 65903659 | 65903690 | 3 | 65835402 | 65839403 | 65899689 | 65903690 |
| 216 | 65839372 | 65839403 | 65903659 | 65903690 | 3 | 65835402 | 65839403 | 65899689 | 65903690 |
| 217 | 131130568 | 131130599 | 131219450 | 131219481 | 7 | 131130568 | 131134569 | 131219450 | 131223451 |
| 218 | 131130568 | 131130599 | 131219450 | 131219481 | 7 | 131130568 | 131134569 | 131219450 | 131223451 |
| 219 | 73690117 | 73690148 | 73758266 | 73758297 | 6 | 73686147 | 73690148 | 73754296 | 73758297 |
| 220 | 73690117 | 73690148 | 73758266 | 73758297 | 6 | 73686147 | 73690148 | 73754296 | 73758297 |
| 221 | 3106299 | 3106330 | 3129940 | 3129971 | 18 | 3106299 | 3110300 | 3129940 | 3133941 |
| 222 | 3106299 | 3106330 | 3129940 | 3129971 | 18 | 3106299 | 3110300 | 3129940 | 3133941 |
| 223 | 36141976 | 36142007 | 36164938 | 36164969 | 5 | 36138006 | 36142007 | 36160968 | 36164969 |
| 224 | 36141976 | 36142007 | 36164938 | 36164969 | 5 | 36138006 | 36142007 | 36160968 | 36164969 |
| 225 | 26999889 | 26999920 | 27044575 | 27044606 | 5 | 26999889 | 27003890 | 27040605 | 27044606 |
| 226 | 26999889 | 26999920 | 27044575 | 27044606 | 5 | 26999889 | 27003890 | 27040605 | 27044606 |
| 227 | 36409666 | 36409697 | 36433268 | 36433299 | 1 | 36409666 | 36413667 | 36433268 | 36437269 |
| 228 | 36409666 | 36409697 | 36433268 | 36433299 | 1 | 36409666 | 36413667 | 36433268 | 36437269 |
| 229 | 66448986 | 66449017 | 66470757 | 66470788 | 2 | 66445016 | 66449017 | 66470757 | 66474758 |
| 230 | 66448986 | 66449017 | 66470757 | 66470788 | 2 | 66445016 | 66449017 | 66470757 | 66474758 |
| 231 | 107626100 | 107626131 | 107708851 | 107708882 | 3 | 107626100 | 107630101 | 107708851 | 107712852 |
| 232 | 107626100 | 107626131 | 107708851 | 107708882 | 3 | 107626100 | 107630101 | 107708851 | 107712852 |
| 233 | 175829279 | 175829310 | 175892267 | 175892298 | 4 | 175829279 | 175833280 | 175892267 | 175896268 |
| 234 | 175829279 | 175829310 | 175892267 | 175892298 | 4 | 175829279 | 175833280 | 175892267 | 175896268 |
| 235 | 6226839 | 6226870 | 6283431 | 6283462 | 5 | 6222869 | 6226870 | 6283431 | 6287432 |
| 236 | 6226839 | 6226870 | 6283431 | 6283462 | 5 | 6222869 | 6226870 | 6283431 | 6287432 |
| 237 | 52380368 | 52384399 | 52462030 | 52462061 | 8 | 52380368 | 52384369 | 52462030 | 52466031 |
| 238 | 52380368 | 52384399 | 52462030 | 52462061 | 8 | 52380368 | 52384369 | 52462030 | 52466031 |
| 239 | 67971637 | 67971668 | 68010294 | 68010325 | 8 | 67971637 | 67975638 | 68010294 | 68014295 |
| 240 | 67971637 | 67971668 | 68010294 | 68010325 | 8 | 67971637 | 67975638 | 68010294 | 68014295 |
| 241 | 38686830 | 38686861 | 38768696 | 38768727 | 9 | 38682860 | 38686861 | 38768696 | 38772697 |
| 242 | 38686830 | 38686861 | 38768696 | 38768727 | 9 | 38682860 | 38686861 | 38768696 | 38772697 |
| 243 | 93565548 | 93565579 | 93583739 | 93583770 | 5 | 93561578 | 93565579 | 93579769 | 93583770 |
| 244 | 93565548 | 93565579 | 93583739 | 93583770 | 5 | 93561578 | 93565579 | 93579769 | 93583770 |
| 245 | 51804670 | 51804701 | 51892245 | 51892276 | 14 | 51804670 | 51808671 | 51888275 | 51892276 |
| 246 | 51804670 | 51804701 | 51892245 | 51892276 | 14 | 51804670 | 51808671 | 51888275 | 51892276 |
| 247 | 146094504 | 146094535 | 146155392 | 146155423 | 6 | 146094504 | 146098505 | 146155392 | 146159393 |
| 248 | 146094504 | 146094535 | 146155392 | 146155423 | 6 | 146094504 | 146098505 | 146155392 | 146159393 |
| 249 | 36776229 | 36776260 | 36803032 | 36803063 | 19 | 36772259 | 36776260 | 36803032 | 36807033 |
| 250 | 36776229 | 36776260 | 36803032 | 36803063 | 19 | 36772259 | 36776260 | 36803032 | 36807033 |
| 251 | 229859020 | 229859051 | 229911260 | 229911291 | 1 | 229859020 | 229863021 | 229907290 | 229911291 |
| 252 | 229859020 | 229859051 | 229911260 | 229911291 | 1 | 229859020 | 229863021 | 229907290 | 229911291 |
| 253 | 45370280 | 45370311 | 45391022 | 45391053 | 7 | 45366310 | 45370311 | 45387052 | 45391053 |
| 254 | 45370280 | 45370311 | 45391022 | 45391053 | 7 | 45366310 | 45370311 | 45387052 | 45391053 |
| 255 | 130198001 | 130198032 | 130252465 | 130252496 | 12 | 130194031 | 130198032 | 130248495 | 130252496 |
| 256 | 130198001 | 130198032 | 130252465 | 130252496 | 12 | 130194031 | 130198032 | 130248495 | 130252496 |
| 257 | 89880613 | 89880644 | 89952946 | 89952977 | 14 | 89880613 | 89884614 | 89952946 | 89956947 |
| 258 | 89880613 | 89880644 | 89952946 | 89952977 | 14 | 89880613 | 89884614 | 89952946 | 89956947 |
| 259 | 206310392 | 206310423 | 206385274 | 206385305 | 1 | 206306422 | 206310423 | 206381304 | 206385305 |
| 260 | 206310392 | 206310423 | 206385274 | 206385305 | 1 | 206306422 | 206310423 | 206381304 | 206385305 |
| 261 | 76098903 | 76098934 | 76127632 | 76127663 | 1 | 76094933 | 76098934 | 76123662 | 76127663 |
| 262 | 76098903 | 76098934 | 76127632 | 76127663 | 1 | 76094933 | 76098934 | 76123662 | 76127663 |
| 263 | 128978278 | 128978309 | 129021767 | 129021798 | 11 | 128974308 | 128978309 | 129021767 | 129025768 |
| 264 | 128978278 | 128978309 | 129021767 | 129021798 | 11 | 128974308 | 128978309 | 129021767 | 129025768 |
| 265 | 78765418 | 78765449 | 78798531 | 78798562 | 2 | 78761448 | 78765449 | 78794561 | 78798562 |
| 266 | 78765418 | 78765449 | 78798531 | 78798562 | 2 | 78761448 | 78765449 | 78794561 | 78798562 |
| 267 | 17393292 | 17393323 | 17434190 | 17434221 | 21 | 17393292 | 17397293 | 17434190 | 17438191 |
| 268 | 17393292 | 17393323 | 17434190 | 17434221 | 21 | 17393292 | 17397293 | 17434190 | 17438191 |
| 269 | 37862801 | 37862832 | 37933142 | 37933173 | 4 | 37858831 | 37862832 | 37929172 | 37933173 |
| 270 | 37862801 | 37862832 | 37933142 | 37933173 | 4 | 37858831 | 37862832 | 37929172 | 37933173 |
| 271 | 23192048 | 23192079 | 23219086 | 23219117 | 7 | 23188078 | 23192079 | 23219086 | 23223087 |
| 272 | 23192048 | 23192079 | 23219086 | 23219117 | 7 | 23188078 | 23192079 | 23219086 | 23223087 |
| 273 | 65562483 | 65562514 | 65630980 | 65631011 | 8 | 65558513 | 65562514 | 65630980 | 65634981 |
| 274 | 65562483 | 65562514 | 65630980 | 65631011 | 8 | 65558513 | 65562514 | 65630980 | 65634981 |
| 275 | 88542085 | 88542116 | 88597081 | 88597112 | 8 | 88542085 | 88546086 | 88593111 | 88597112 |
| 276 | 88542085 | 88542116 | 88597081 | 88597112 | 8 | 88542085 | 88546086 | 88593111 | 88597112 |
| 277 | 56329605 | 56329636 | 56394093 | 56394124 | 2 | 56325635 | 56329636 | 56390123 | 56394124 |
| 278 | 56329605 | 56329636 | 56394093 | 56394124 | 2 | 56325635 | 56329636 | 56390123 | 56394124 |
| 279 | 63282250 | 63282281 | 63308360 | 63308391 | 3 | 63278280 | 63282281 | 63308360 | 63312361 |
| 280 | 63282250 | 63282281 | 63308360 | 63308391 | 3 | 63278280 | 63282281 | 63308360 | 63312361 |
| 281 | 27764811 | 27764842 | 27800700 | 27800731 | 8 | 27764811 | 27768812 | 27796730 | 27800731 |
| 282 | 27764811 | 27764842 | 27800700 | 27800731 | 8 | 27764811 | 27768812 | 27796730 | 27800731 |
| 283 | 113413840 | 113413871 | 113446051 | 113446082 | 8 | 113409870 | 113413871 | 113442081 | 113446082 |
| 284 | 113413840 | 113413871 | 113446051 | 113446082 | 8 | 113409870 | 113413871 | 113442081 | 113446082 |
| 285 | 96187243 | 96187274 | 96241318 | 96241349 | 12 | 96187243 | 96191244 | 96237348 | 96241349 |
| 286 | 96187243 | 96187274 | 96241318 | 96241349 | 12 | 96187243 | 96191244 | 96237348 | 96241349 |

TABLE 1.d7

| | Probe | PCR-Primer1_ID | PCR_Primer1 |
|---|---|---|---|
| 213 | ORF152_14_106693397_106698909_106739902_106745380_RR | OBD159_417 | TTATGCCCCACCTTCTTCAGTGTAAT (SEQ ID NO: 712) |
| 214 | ORF152_14_106693397_106698909_106739902_106745380_RR | OBD159_417 | TTATGCCCCACCTTCTTCAGTGTAAT (SEQ ID NO: 712) |
| 215 | ORF153_3_65835051_65839403_65898255_65903690_FF | OBD159_421 | ACCTACTGTGCTGCCAGACATAGAAA (SEQ ID NO: 476) |
| 216 | ORF153_3_65835051_65839403_65898255_65903690_FF | OBD159_421 | ACCTACTGTGCTGCCAGACATAGAAA (SEQ ID NO: 476) |
| 217 | ORF153_7_131130568_131132000_131219450_131221740_RR | OBD159_425 | TCCCTTGAAAACCTGTGTCCAATGAC (SEQ ID NO: 716) |
| 218 | ORF153_7_131130568_131132000_131219450_131221740_RR | OBD159_425 | TCCCTTGAAAACCTGTGTCCAATGAC (SEQ ID NO: 716) |
| 219 | ORF154_6_73688989_73690148_73751804_73758297_FF | OBD159_429 | TCAGTGTTTGCTTTTCCCTTGAAT (SEQ ID NO: 718) |
| 220 | ORF154_6_73688989_73690148_73751804_73758297_FF | OBD159_429 | TCAGTGTTTGCTTTTCCCTTGAAT (SEQ ID NO: 718) |
| 221 | ORF155_18_3106299_3108561_3129940_3131675_RR | OBD159_433 | AGGTTGAAGTTGAAACACAGATGT (SEQ ID NO: 720) |
| 222 | ORF155_18_3106299_3108561_3129940_3131675_RR | OBD159_433 | AGGTTGAAGTTGAAACACAGATGT (SEQ ID NO: 720) |
| 223 | ORF155_5_36136424_36142007_36160830_36164969_FF | OBD159_437 | TTTTTAATAGTGCTTCAAA (SEQ ID NO: 722) |
| 224 | ORF155_5_36136424_36142007_36160830_36164969_FF | OBD159_437 | TTTTTAATAGTGCTTCAAA (SEQ ID NO: 722) |
| 225 | ORF158_5_26999889_27004744_27042244_27044606_RF | OBD159_441 | CTCTTTTATTTACCACTCCATTCTTCCA (SEQ ID NO: 724) |
| 226 | ORF158_5_26999889_27004744_27042244_27044606_RF | OBD159_441 | CTCTTTTATTTACCACTCCATTCTTCCA (SEQ ID NO: 724) |
| 227 | ORF16_1_36409666_36411937_36433268_36434547_RR | OBD159_165 | GAAGCGAGTTGCTGTCACTGGAG (SEQ ID NO: 248) |
| 228 | ORF16_1_36409666_36411937_36433268_36434547_RR | OBD159_165 | GAAGCGAGTTGCTGTCACTGGAG (SEQ ID NO: 248) |
| 229 | ORF16_2_66446190_66449017_66470757_66475654_FR | OBD159_445 | CCACTGTCAGGGAAATAGTTGAAGGA (SEQ ID NO: 728) |
| 230 | ORF16_2_66446190_66449017_66470757_66475654_FR | OBD159_445 | CCACTGTCAGGGAAATAGTTGAAGGA (SEQ ID NO: 728) |
| 231 | ORF16_3_107626100_107637571_107708851_107713617_RR | OBD159_449 | CAGAAAAGCCCAGGAAGGTATCAGAT (SEQ ID NO: 730) |
| 232 | ORF16_3_107626100_107637571_107708851_107713617_RR | OBD159_449 | CAGAAAAGCCCAGGAAGGTATCAGAT (SEQ ID NO: 730) |
| 233 | ORF16_4_175829279_175833051_175892267_175894404_RR | OBD159_453 | CCACTGACTTCACTGTTTAA (SEQ ID NO: 732) |
| 234 | ORF16_4_175829279_175833051_175892267_175894404_RR | OBD159_453 | CCACTGACTTCACTGTTTAA (SEQ ID NO: 732) |
| 235 | ORF16_5_6223946_6226870_6283431_6289065_FR | OBD159_457 | CTGTTCTCAGCAATGGAATCTCAGGT (SEQ ID NO: 102) |
| 236 | ORF16_5_6223946_6226870_6283431_6289065_FR | OBD159_457 | CTGTTCTCAGCAATGGAATCTCAGGT (SEQ ID NO: 102) |
| 237 | ORF16_8_52380368_52388099_52462030_52466077_RR | OBD159_461 | AGGGAGAGGAGACAGATGTTCTTTCT (SEQ ID NO: 736) |
| 238 | ORF16_8_52380368_52388099_52462030_52466077_RR | OBD159_461 | AGGGAGAGGAGACAGATGTTCTTTCT (SEQ ID NO: 736) |

TABLE 1.d7-continued

| Probe | PCR-Primer1_ID | PCR_Primer1 |
|---|---|---|
| 239 ORF16_8_67971637_67976278_68010294_68014710_RR | OBD159_465 | CACTGTTGTCTTATTGCCTTGCTCAG (SEQ ID NO: 738) |
| 240 ORF16_8_67971637_67976278_68010294_68014710_RR | OBD159_465 | CACTGTTGTCTTATTGCCTTGCTCAG (SEQ ID NO: 738) |
| 241 ORF16_9_38681931_38686861_38768696_38769724_FR | OBD159_469 | CAGAAGTTCACAGGCAGGGTGTC (SEQ ID NO: 258) |
| 242 ORF16_9_38681931_38686861_38768696_38769724_FR | OBD159_469 | CAGAAGTTCACAGGCAGGGTGTC (SEQ ID NO: 258) |
| 243 ORF160_5_93562856_93565579_93582366_93583770_FF | OBD159_473 | ATGCCCAGTCATAGGTGATAAGATTA (SEQ ID NO: 742) |
| 244 ORF160_5_93562856_93565579_93582366_93583770_FF | OBD159_473 | ATGCCCAGTCATAGGTGATAAGATTA (SEQ ID NO: 742) |
| 245 ORF162_14_51804670_51807147_51886119_51892276_RF | OBD159_477 | GTTCCTCTTGCTCCACTTGTCAACAG (SEQ ID NO: 744) |
| 246 ORF162_14_51804670_51807147_51886119_51892276_RF | OBD159_477 | GTTCCTCTTGCTCCACTTGTCAACAG (SEQ ID NO: 744) |
| 247 ORF162_6_146094504_146104695_146155392_146161780_RR | OBD159_481 | CACATACACAGGGTAACCTAAGGAA G (SEQ ID NO: 746) |
| 248 ORF162_6_146094504_146104695_146155392_146161780_RR | OBD159_481 | CACATACACAGGGTAACCTAAGGAA G (SEQ ID NO: 746) |
| 249 ORF163_19_36775089_36776260_36803032_36806792_FR | OBD159_485 | ATGATAGGCACATACTCTCCTCTG (SEQ ID NO: 748) |
| 250 ORF163_19_36775089_36776260_36803032_36806792_FR | OBD159_485 | ATGATAGGCACATACTCTCCTCTG (SEQ ID NO: 748) |
| 251 ORF164_1_229859020_229862315_229908605_229911291_RF | OBD159_489 | TGTCATTTTCACACCATCCTCCCCAT (SEQ ID NO: 750) |
| 252 ORF164_1_229859020_229862315_229908605_229911291_RF | OBD159_489 | TGTCATTTTCACACCATCCTCCCCAT (SEQ ID NO: 750) |
| 253 ORF164_7_45364155_45370311_45384350_45391053_FF | OBD159_493 | GAGTTTGGAGGTGTTCTCTGCCCTTT (SEQ ID NO: 752) |
| 254 ORF164_7_45364155_45370311_45384350_45391053_FF | OBD159_493 | GAGTTTGGAGGTGTTCTCTGCCCTTT (SEQ ID NO: 752) |
| 255 ORF166_12_130196441_130198032_130248318_130252496_FF | OBD159_497 | GCGGAGGGAGAGTCACGCAAGAT (SEQ ID NO: 754) |
| 256 ORF166_12_130196441_130198032_130248318_130252496_FF | OBD159_497 | GCGGAGGGAGAGTCACGCAAGAT (SEQ ID NO: 754) |
| 257 ORF166_14_89880613_89884758_89952946_89954082_RR | OBD159_501 | ACCCAGGTGGTATGACTCCAGAG (SEQ ID NO: 756) |
| 258 ORF166_14_89880613_89884758_89952946_89954082_RR | OBD159_501 | ACCCAGGTGGTATGACTCCAGAG (SEQ ID NO: 756) |
| 259 ORF169_1_206307932_206310423_206383244_206385305_FF | OBD159_505 | GAGGCTCAGGCAACATCCTACTTTCA (SEQ ID NO: 758) |
| 260 ORF169_1_206307932_206310423_206383244_206385305_FF | OBD159_505 | GAGGCTCAGGCAACATCCTACTTTCA (SEQ ID NO: 758) |
| 261 ORF17_1_76086337_76098934_76123667_76127663_FF | OBD159_509 | CTTTACTGGTGTCTTTTATGAACAA (SEQ ID NO: 760) |
| 262 ORF17_1_76086337_76098934_76123667_76127663_FF | OBD159_509 | CTTTACTGGTGTCTTTTATGAACAA (SEQ ID NO: 760) |
| 263 ORF17_11_128975846_128978309_129021767_129026895_FR | OBD159_513 | GCTGGTCTTGAACTCCTGGCTTC (SEQ ID NO: 762) |
| 264 ORF17_11_128975846_128978309_129021767_129026895_FR | OBD159_513 | GCTGGTCTTGAACTCCTGGCTTC |

TABLE 1.d7-continued

| Probe | PCR-Primer1_ID | PCR_Primer1 |
|---|---|---|
| | | (SEQ ID NO: 762) |
| 265 ORF17_2_78763526_78765449_78792347_78798562_FF | OBD159_517 | GATTTCTCAGTTTACATAGTTCAAA (SEQ ID NO: 764) |
| 266 ORF17_2_78763526_78765449_78792347_78798562_FF | OBD159_517 | GATTTCTCAGTTTACATAGTTCAAA (SEQ ID NO: 764) |
| 267 ORF17_21_17393292_17394472_17434190_17435748_RR | OBD159_521 | TACCAGGGCTGAGGGTGTTGTCCTA T (SEQ ID NO: 766) |
| 268 ORF17_21_17393292_17394472_17434190_17435748_RR | OBD159_521 | TACCAGGGCTGAGGGTGTTGTCCTA T (SEQ ID NO: 766) |
| 269 ORF17_4_37859966_37862832_37927829_37933173_FF | OBD159_525 | ACCTAAATAGTTATGAACAGTTTC (SEQ ID NO: 768) |
| 270 ORF17_4_37859966_37862832_37927829_37933173_FF | OBD159_525 | ACCTAAATAGTTATGAACAGTTTC (SEQ ID NO: 768) |
| 271 ORF17_7_23187280_23192079_23219086_23222886_FR | OBD159_529 | AAGTCAAGGCGGCAGTGAGCCAC (SEQ ID NO: 770) |
| 272 ORF17_7_23187280_23192079_23219086_23222886_FR | OBD159_529 | AAGTCAAGGCGGCAGTGAGCCAC (SEQ ID NO: 770) |
| 273 ORF17_8_65560550_65562514_65630980_65632323_FR | OBD159_533 | CATTTCTCTGCTGCCATCTCGTGGAT (SEQ ID NO: 772) |
| 274 ORF17_8_65560550_65562514_65630980_65632323_FR | OBD159_533 | CATTTCTCTGCTGCCATCTCGTGGAT (SEQ ID NO: 772) |
| 275 ORF17_8_88542085_88553888_88592759_88597112_RF | OBD159_537 | ACCTGACCAAACTTGAATAAATCA (SEQ ID NO: 774) |
| 276 ORF17_8_88542085_88553888_88592759_88597112_RF | OBD159_537 | ACCTGACCAAACTTGAATAAATCA (SEQ ID NO: 774) |
| 277 ORF170_2_56323476_56329636_56390760_56394124_FF | OBD159_541 | CTGGAGAGGAGGAGTCTTGTTTGCT T (SEQ ID NO: 776) |
| 278 ORF170_2_56323476_56329636_56390760_56394124_FF | OBD159_541 | CTGGAGAGGAGGAGTCTTGTTTGCT T (SEQ ID NO: 776) |
| 279 ORF171_3_63280859_63282281_63308360_63313318_FR | OBD159_545 | AACTATTTTCACATCATCTTGTAAG (SEQ ID NO: 778) |
| 280 ORF171_3_63280859_63282281_63308360_63313318_FR | OBD159_545 | AACTATTTTCACATCATCTTGTAAG (SEQ ID NO: 778) |
| 281 ORF171_8_27764811_27768513_27798255_27800731_RF | OBD159_549 | GGTGTGGAATACAATCTGATGGTTTC (SEQ ID NO: 780) |
| 282 ORF171_8_27764811_27768513_27798255_27800731_RF | OBD159_549 | GGTGTGGAATACAATCTGATGGTTTC (SEQ ID NO: 780) |
| 283 ORF173_8_113409304_113413871_113438847_113446082_FF | OBD159_553 | AGTTCTCAACCTGTGGGATGTATTAT (SEQ ID NO: 782) |
| 284 ORF173_8_113409304_113413871_113438847_113446082_FF | OBD159_553 | AGTTCTCAACCTGTGGGATGTATTAT (SEQ ID NO: 782) |
| 285 ORF176_12_96187243_96188661_96237099_96241349_RF | OBD159_557 | GGCTTTATGCCTGGGTCAGTTCTCCT (SEQ ID NO: 784) |
| 286 ORF176_12_96187243_96188661_96237099_96241349_RF | OBD159_557 | GGCTTTATGCCTGGGTCAGTTCTCCT (SEQ ID NO: 784) |

TABLE 1.d8

| | PCR-Primer2_ID | PCR_Primer2 | Marker | GLMNET |
|---|---|---|---|---|
| 213 | OBD159_419 | TTATGCCCCACCTTCTTCAGGGTAAT (SEQ ID NO: 786) | OBD159_417_419 | -0.00076144 |

TABLE 1.d8-continued

| | PCR-Primer2_ID | PCR_Primer2 | Marker | GLMNET |
|---|---|---|---|---|
| 214 | OBD159_419 | TTATGCCCCACCTTCTTCAGGGTAAT (SEQ ID NO: 786) | OBD159_417_419 | -0.00076144 |
| 215 | OBD159_423 | CCAGGATAACAGCAATGCCTACTTCC (SEQ ID NO: 788) | OBD159_421_423 | -0.001555895 |
| 216 | OBD159_423 | CCAGGATAACAGCAATGCCTACTTCC (SEQ ID NO: 788) | OBD159_421_423 | -0.001555895 |
| 217 | OBD159_427 | ATTACCTCACCCTTCCTCCTGTGCTG (SEQ ID NO: 790) | OBD159_425_427 | -0.002923934 |
| 218 | OBD159_427 | ATTACCTCACCCTTCCTCCTGTGCTG (SEQ ID NO: 790) | OBD159_425_427 | -0.002923934 |
| 219 | OBD159_431 | TTGAATGGTGAGGTGCCTTGTTAT (SEQ ID NO: 792) | OBD159_429_431 | -0.000485603 |
| 220 | OBD159_431 | TTGAATGGTGAGGTGCCTTGTTAT (SEQ ID NO: 792) | OBD159_429_431 | -0.000485603 |
| 221 | OBD159_435 | AAGAAAACGAAGGAAGGAAGATTC (SEQ ID NO: 794) | OBD159_433_435 | -0.00351129 |
| 222 | OBD159_435 | AAGAAAACGAAGGAAGGAAGATTC (SEQ ID NO: 794) | OBD159_433_435 | -0.00351129 |
| 223 | OBD159_439 | TTATAACAAAATATCATG (SEQ ID NO: 796) | OBD159_437_439 | -0.002029871 |
| 224 | OBD159_439 | TTATAACAAAATATCATG (SEQ ID NO: 796) | OBD159_437_439 | -0.002029871 |
| 225 | OBD159_443 | AAAACTCATTGCCAAACCCAAGGTCAT (SEQ ID NO: 798) | OBD159_441_443 | -0.002006752 |
| 226 | OBD159_443 | AAAACTCATTGCCAAACCCAAGGTCAT (SEQ ID NO: 798) | OBD159_441_443 | -0.002006752 |
| 227 | OBD159_167 | CCCCAACACAAACTGTCCTCAGGC (SEQ ID NO: 308) | OBD159_165_167 | -0.005793058 |
| 228 | OBD159_167 | CCCCAACACAAACTGTCCTCAGGC (SEQ ID NO: 308) | OBD159_165_167 | -0.005793058 |
| 229 | OBD159_447 | ATCAATGCCTGTGAACTATGAAAAGC (SEQ ID NO: 802) | OBD159_445_447 | -0.002760872 |
| 230 | OBD159_447 | ATCAATGCCTGTGAACTATGAAAAGC (SEQ ID NO: 802) | OBD159_445_447 | -0.002760872 |
| 231 | OBD159_451 | CCCTCCAACTGCTTGCCTATCCTTTG (SEQ ID NO: 804) | OBD159_449_451 | -0.002333999 |
| 232 | OBD159_451 | CCCTCCAACTGCTTGCCTATCCTTTG (SEQ ID NO: 804) | OBD159_449_451 | -0.002333999 |
| 233 | OBD159_455 | TCAAATGTCCAATACTGTCTATC (SEQ ID NO: 806) | OBD159_453_455 | -0.001769071 |
| 234 | OBD159_455 | TCAAATGTCCAATACTGTCTATC (SEQ ID NO: 806) | OBD159_453_455 | -0.001769071 |
| 235 | OBD159_459 | TCCCTTCTCCTGATTTTCCCTGTGGA (SEQ ID NO: 808) | OBD159_457_459 | -0.002314144 |
| 236 | OBD159_459 | TCCCTTCTCCTGATTTTCCCTGTGGA (SEQ ID NO: 808) | OBD159_457_459 | -0.002314144 |
| 237 | OBD159_463 | CTTCAAGTCTGTTTGCCTATTATTGC (SEQ ID NO: 810) | OBD159_461_463 | -0.002502897 |
| 238 | OBD159_463 | CTTCAAGTCTGTTTGCCTATTATTGC (SEQ ID NO: 810) | OBD159_461_463 | -0.002502897 |
| 239 | OBD159_467 | CCCTTTCTCCTCCTCTCTGCTCCTAT (SEQ ID NO: 812) | OBD159_465_467 | -0.001657289 |

TABLE 1.d8-continued

| | PCR-Primer2_ID | PCR_Primer2 | Marker | GLMNET |
|---|---|---|---|---|
| 240 | OBD159_467 | CCCTTTCTCCTCCTCTCTGCTCCTAT (SEQ ID NO: 812) | OBD159_465_467 | -0.001657289 |
| 241 | OBD159_471 | GCTCCAGCACCGTATTTCGCCTG (SEQ ID NO: 814) | OBD159_469_471 | -0.001827556 |
| 242 | OBD159_471 | GCTCCAGCACCGTATTTCGCCTG (SEQ ID NO: 814) | OBD159_469_471 | -0.001827556 |
| 243 | OBD159_475 | GAAGCAGAAGAAGGAGCAAGAAAG (SEQ ID NO: 816) | OBD159_473_475 | -0.003164542 |
| 244 | OBD159_475 | GAAGCAGAAGAAGGAGCAAGAAAG (SEQ ID NO: 816) | OBD159_473_475 | -0.003164542 |
| 245 | OBD159_479 | GCTTCAGTAAATACCGCCAAACG (SEQ ID NO: 818) | OBD159_477_479 | -0.003908131 |
| 246 | OBD159_479 | GCTTCAGTAAATACCGCCAAACG (SEQ ID NO: 818) | OBD159_477_479 | -0.003908131 |
| 247 | OBD159_483 | CTGAAAAGATGCTCTGCTACTGGGTG (SEQ ID NO: 820) | OBD159_481_483 | -0.000935051 |
| 248 | OBD159_483 | CTGAAAAGATGCTCTGCTACTGGGTG (SEQ ID NO: 820) | OBD159_481_483 | -0.000935051 |
| 249 | OBD159_487 | TATCGGAACGGTAACCAATCTCATTA (SEQ ID NO: 822) | OBD159_485_487 | -0.002492994 |
| 250 | OBD159_487 | TATCGGAACGGTAACCAATCTCATTA (SEQ ID NO: 822) | OBD159_485_487 | -0.002492994 |
| 251 | OBD159_491 | TGAAAGAGGCACCAGATGCGGAGGAA (SEQ ID NO: 824) | OBD159_489_491 | -0.003044831 |
| 252 | OBD159_491 | TGAAAGAGGCACCAGATGCGGAGGAA (SEQ ID NO: 824) | OBD159_489_491 | -0.003044831 |
| 253 | OBD159_495 | CCAACAACAATCTCCTTCCTCTCTAT (SEQ ID NO: 826) | OBD159_493_495 | -0.000859479 |
| 254 | OBD159_495 | CCAACAACAATCTCCTTCCTCTCTAT (SEQ ID NO: 826) | OBD159_493_495 | -0.000859479 |
| 255 | OBD159_499 | GCTGGGAGGGTCTTACACTGAGT (SEQ ID NO: 828) | OBD159_497_499 | -0.002097728 |
| 256 | OBD159_499 | GCTGGGAGGGTCTTACACTGAGT (SEQ ID NO: 828) | OBD159_497_499 | -0.002097728 |
| 257 | OBD159_503 | GGCAAGTTTCCTGCTCACCCCTG (SEQ ID NO: 830) | OBD159_501_503 | -0.003841992 |
| 258 | OBD159_503 | GGCAAGTTTCCTGCTCACCCCTG (SEQ ID NO: 830) | OBD159_501_503 | -0.003841992 |
| 259 | OBD159_507 | CTCTGAAGCCAAGCATAGATAGATGG (SEQ ID NO: 832) | OBD159_505_507 | -0.003217459 |
| 260 | OBD159_507 | CTCTGAAGCCAAGCATAGATAGATGG (SEQ ID NO: 832) | OBD159_505_507 | -0.003217459 |
| 261 | OBD159_511 | GAAGGTTCTGTCTTTATTTACAAT (SEQ ID NO: 834) | OBD159_509_511 | -0.001863975 |
| 262 | OBD159_511 | GAAGGTTCTGTCTTTATTTACAAT (SEQ ID NO: 834) | OBD159_509_511 | -0.001863975 |
| 263 | OBD159_515 | CGAGGTGGTAAAGTCAGCAAGTTA (SEQ ID NO: 836) | OBD159_513_515 | -0.00204202 |
| 264 | OBD159_515 | CGAGGTGGTAAAGTCAGCAAGTTA (SEQ ID NO: 836) | OBD159_513_515 | -0.00204202 |
| 265 | OBD159_519 | ATCTCTTAGTCTTAGCATCTATCA (SEQ ID NO: 838) | OBD159_517_519 | -0.002864437 |

TABLE 1.d8-continued

| | PCR-Primer2_ID | PCR_Primer2 | Marker | GLMNET |
|---|---|---|---|---|
| 266 | OBD159_519 | ATCTCTTAGTCTTAGCATCTATCA (SEQ ID NO: 838) | OBD159_517_519 | -0.002864437 |
| 267 | OBD159_523 | GGTATTGGCAACTAAAACGATTCCTC (SEQ ID NO: 840) | OBD159_521_523 | -0.002896744 |
| 268 | OBD159_523 | GGTATTGGCAACTAAAACGATTCCTC (SEQ ID NO: 840) | OBD159_521_523 | -0.002896744 |
| 269 | OBD159_527 | GGTGACAGACTGAGACTCCATTTA (SEQ ID NO: 842) | OBD159_525_527 | -0.002960188 |
| 270 | OBD159_527 | GGTGACAGACTGAGACTCCATTTA (SEQ ID NO: 842) | OBD159_525_527 | -0.002960188 |
| 271 | OBD159_531 | GCCTTCCACCAAGTCACAAAGAC (SEQ ID NO: 844) | OBD159_529_531 | -0.003593697 |
| 272 | OBD159_531 | GCCTTCCACCAAGTCACAAAGAC (SEQ ID NO: 844) | OBD159_529_531 | -0.003593697 |
| 273 | OBD159_535 | CAGTGACCACAGTTTCTGCCTCTG (SEQ ID NO: 846) | OBD159_533_535 | -0.003278418 |
| 274 | OBD159_535 | CAGTGACCACAGTTTCTGCCTCTG (SEQ ID NO: 846) | OBD159_533_535 | -0.003278418 |
| 275 | OBD159_539 | CATTTCATTCTACTGGATTCAGAT (SEQ ID NO: 848) | OBD159_537_539 | -0.002009464 |
| 276 | OBD159_539 | CATTTCATTCTACTGGATTCAGAT (SEQ ID NO: 848) | OBD159_537_539 | -0.002009464 |
| 277 | OBD159_543 | CTCACTAATGACATCCCACATCGCAG (SEQ ID NO: 850) | OBD159_541_543 | -0.005427277 |
| 278 | OBD159_543 | CTCACTAATGACATCCCACATCGCAG (SEQ ID NO: 850) | OBD159_541_543 | -0.005427277 |
| 279 | OBD159_547 | AGAAAGTCTCAAACAGAAGGCAAAT (SEQ ID NO: 852) | OBD159_545_547 | -0.004238773 |
| 280 | OBD159_547 | AGAAAGTCTCAAACAGAAGGCAAAT (SEQ ID NO: 852) | OBD159_545_547 | -0.004238773 |
| 281 | OBD159_551 | GGGTTAGTAGGAGAAATGTAAAACTC (SEQ ID NO: 854) | OBD159_549_551 | -0.002929423 |
| 282 | OBD159_551 | GGGTTAGTAGGAGAAATGTAAAACTC (SEQ ID NO: 854) | OBD159_549_551 | -0.002929423 |
| 283 | OBD159_555 | AAAGTGCTAAGTTTGTGAGGTGATAG (SEQ ID NO: 856) | OBD159_553_555 | -0.003533315 |
| 284 | OBD159_555 | AAAGTGCTAAGTTTGTGAGGTGATAG (SEQ ID NO: 856) | OBD159_553_555 | -0.003533315 |
| 285 | OBD159_559 | CCTAACACCTGCCAAGAAAGTGCTAA (SEQ ID NO: 858) | OBD159_557_559 | -0.001914862 |
| 286 | OBD159_559 | CCTAACACCTGCCAAGAAAGTGCTAA (SEQ ID NO: 858) | OBD159_557_559 | -0.001914862 |

TABLE 1.d9

| | Gene |
|---|---|
| 213 | rs2337406; rs11846409 |
| 214 | rs2337406; rs11846409 |
| 215 | MAGI1; rs145965284 |
| 216 | MAGI1; rs145965284 |
| 217 | MKLN1; rs114034759 |
| 218 | MKLN1; rs114034759 |
| 219 | CD109; SLC17A5 |

TABLE 1.d9-continued

| | Gene |
|---|---|
| 220 | CD109; SLC17A5 |
| 221 | MYOM1; rs751200138 |
| 222 | MYOM1; rs751200138 |
| 223 | LMBRD2; SKP2; rs2270909; rs12657634; rs10941274; rs12655052; rs3804446 |
| 224 | LMBRD2; SKP2; rs2270909; rs12657634; rs10941274; rs12655052; rs3804446 |

TABLE 1.d9-continued

| | Gene |
|---|---|
| 225 | CDH9; rs201058683 |
| 226 | CDH9; rs201058683 |
| 227 | LSM10; OSCP1 |
| 228 | LSM10; OSCP1 |
| 229 | MEIS1; rs11692361 |
| 230 | MEIS1; rs11692361 |
| 231 | BBX; rs11710737 |
| 232 | BBX; rs11710737 |
| 233 | GPM6A; rs1106568 |
| 234 | GPM6A; rs1106568 |
| 235 | rs12518614 |
| 236 | rs12518614 |
| 237 | ST18; rs7820212 |
| 238 | ST18; rs7820212 |
| 239 | PREX2; rs4512367 |
| 240 | PREX2; rs4512367 |
| 241 | ANKRD18A; CNTNAP3 |
| 242 | ANKRD18A; CNTNAP3 |
| 243 | NR2F1; rs587777277 |
| 244 | NR2F1; rs587777277 |
| 245 | FRMD6; GNG2; rs8015138 |
| 246 | FRMD6; GNG2; rs8015138 |
| 247 | GRM1; SHPRH |
| 248 | GRM1; SHPRH |
| 249 | ZNF790; ZNF850 |
| 250 | ZNF790; ZNF850 |
| 251 | GALNT2; rs4925506 |
| 252 | GALNT2; rs4925506 |
| 253 | ADCY1; rs1294908 |
| 254 | ADCY1; rs1294908 |
| 255 | FZD10; PIWIL1 |
| 256 | FZD10; PIWIL1 |
| 257 | EFCAB11; TDP1 |
| 258 | EFCAB11; TDP1 |
| 259 | SRGAP2; rs2987927 |
| 260 | SRGAP2; rs2987927 |
| 261 | ST6GALNAC3; rs915404 |
| 262 | ST6GALNAC3; rs915404 |
| 263 | ARHGAP32; rs11221522 |
| 264 | ARHGAP32; rs11221522 |
| 265 | REG3G |
| 266 | REG3G |
| 267 | CXADR |
| 268 | CXADR |
| 269 | GAFA3; PGM2; PTTG2; TBC1D1; rs17578878; rs35859249 |
| 270 | GAFA3; PGM2; PTTG2; TBC1D1; rs17578878; rs35859249 |
| 271 | NUPL2; rs858249 |
| 272 | NUPL2; rs858249 |
| 273 | ARMC1; rs6991838 |
| 274 | ARMC1; rs6991838 |
| 275 | rs10504861; rs7838490; rs7819570; rs11995572 |
| 276 | rs10504861; rs7838490; rs7819570; rs11995572 |
| 277 | CCDC85A; rs186920977; rs6747380; rs17268785 |
| 278 | CCDC85A; rs186920977; rs6747380; rs17268785 |
| 279 | SYNPR; rs13098482 |
| 280 | SYNPR; rs13098482 |
| 281 | CCDC25; ESCO2; rs80359869; rs80359844; rs80359845; rs80359846; rs80359847; rs80359848; rs80359849; rs80359850; rs80359851; rs80359852; rs80359853; rs80359854; rs80359855; rs80359856; rs80359857; rs797045565; rs797045566; rs80359858; rs80359859; rs80359861; rs80359862; rs146312522; rs80359863; rs80359864; rs80359865; rs80359866; rs80359867; rs80359868 |
| 282 | CCDC25; ESCO2; rs80359869; rs80359844; rs80359845; rs80359846; rs80359847; rs80359848; rs80359849; rs80359850; rs80359851; rs80359852; rs80359853; rs80359854; rs80359855; rs80359856; rs80359857; rs797045565; rs797045566; rs80359858; rs80359859; rs80359861; rs80359862; rs146312522; rs80359863; rs80359864; rs80359865; rs80359866; rs80359867; rs80359868 |
| 283 | CSMD3; rs189590409 |
| 284 | CSMD3; rs189590409 |
| 285 | CDK17; ELK3; rs4762284 |
| 286 | CDK17; ELK3; rs4762284 |

TABLE 1.e1

| | Probe | GeneLocus |
|---|---|---|
| 287 | ORF176_6_70049970_70053583_70128487_70130693_RR | COL19A1; rs771562232 |
| 288 | ORF176_6_70049970_70053583_70128487_70130693_RR | COL19A1; rs771562232 |
| 289 | ORF177_4_175618295_175622237_175657671_175665421_FF | GPM6A; rs13144140 |
| 290 | ORF177_4_175618295_175622237_175657671_175665421_FF | GPM6A; rs13144140 |
| 291 | ORF178_6_157189218_157193153_157237058_157240060_FF | ARID1B; rs1057518918; rs1057518691; rs773740590; rs886044620; rs797044859; rs879253746; rs797045278; rs1057518984; rs797045279; rs797045280; rs797045281; rs797045282; rs886041706; rs797045283; rs9406316 |
| 292 | ORF178_6_157189218_157193153_157237058_157240060_FF | ARID1B; rs1057518918; rs1057518691; rs773740590; rs886044620; rs797044859; rs879253746; rs797045278; rs1057518984; rs797045279; rs797045280; rs797045281; rs797045282; rs886041706; rs797045283; rs9406316 |
| 293 | ORF179_6_151443530_151449164_151503790_151504867_FR | C6orf211; CCDC170; RMND1; rs370863743; rs6933660; rs1971256 |
| 294 | ORF179_6_151443530_151449164_151503790_151504867_FR | C6orf211; CCDC170; RMND1; rs370863743; rs6933660; rs1971256 |
| 295 | ORF179_X_110436218_110442213_110470734_110476806_FF | AMMECR1; RGAG1; rs1573036 |
| 296 | ORF179_X_110436218_110442213_110470734_110476806_FF | AMMECR1; RGAG1; rs1573036 |
| 297 | ORF18_12_75093036_75104058_75141366_75143140_RF | CAPS2; KCNC2 |
| 298 | ORF18_12_75093036_75104058_75141366_75143140_RF | CAPS2; KCNC2 |
| 299 | ORF18_2_20303337_20304942_20340862_20341927_FR | PUM2; rs111612372 |
| 300 | ORF18_2_20303337_20304942_20340862_20341927_FR | PUM2; rs111612372 |
| 301 | ORF18_3_107703592_107708851_107736901_107739665_RR | BBX; rs11710737 |
| 302 | ORF18_3_107703592_107708851_107736901_107739665_RR | BBX; rs11710737 |
| 303 | ORF18_4_37845589_37847420_37859966_37862832_RF | GAFA3; PGM2 |
| 304 | ORF18_4_37845589_37847420_37859966_37862832_RF | GAFA3; PGM2 |
| 305 | ORF18_4_37845589_37847420_37862832_37864637_RR | GAFA3; PGM2 |
| 306 | ORF18_4_37845589_37847420_37862832_37864637_RR | GAFA3; PGM2 |
| 307 | ORF18_8_22370928_22373682_22443319_22445881_FF | PIWIL2; PPP3CC; SLC39A14; rs879253763; rs879253764; rs879253765; rs1039778197; rs879253766; rs750281602; rs7833266; rs2272080 |
| 308 | ORF18_8_22370928_22373682_22443319_22445881_FF | PIWIL2; PPP3CC; SLC39A14; rs879253763; rs879253764; rs879253765; rs1039778197; rs879253766; rs750281602; rs7833266; rs2272080 |
| 309 | ORF18_9_38681931_38686861_38768696_38769724_FF | ANKRD18A; CNTNAP3 |
| 310 | ORF18_9_38681931_38686861_38768696_38769724_FF | ANKRD18A; CNTNAP3 |
| 311 | ORF18_X_130743981_130757818_130793708_130805512_RR | ARHGAP36; ENOX2 |
| 312 | ORF18_X_130743981_130757818_130793708_130805512_RR | ARHGAP36; ENOX2 |
| 313 | ORF180_2_195583610_195589061_195640867_195645128_FR | DNAH7; SLC39A10 |
| 314 | ORF180_2_195583610_195589061_195640867_195645128_FR | DNAH7; SLC39A10 |

TABLE 1.e1-continued

| | Probe | GeneLocus |
|---|---|---|
| 315 | ORF181_2_129231919_129233302_<br>129249318_129258610_FF | rs7567687; rs1660895 |
| 316 | ORF181_2_129231919_129233302_<br>129249318_129258610_FF | rs7567687; rs1660895 |
| 317 | ORF182_7_28717278_28719857_<br>28738396_28739641_RF | CREB5; rs56388170 |
| 318 | ORF182_7_28717278_28719857_<br>28738396_28739641_RF | CREB5; rs56388170 |
| 319 | ORF185_18_58155952_58157838_<br>58215328_58217936_RF | NEDD4L; rs4149601 |
| 320 | ORF185_18_58155952_58157838_<br>58215328_58217936_RF | NEDD4L; rs4149601 |
| 321 | ORF185_4_82581680_82585686_<br>82618801_82621987_FR | rs13138355; rs72909131 |
| 322 | ORF185_4_82581680_82585686_<br>82618801_82621987_FR | rs13138355; rs72909131 |
| 323 | ORF185_6_151443530_151449164_<br>151537463_151538576_FR | C6orf211; CCDC170;<br>RMND1; rs370863743;<br>rs6933660; rs1971256;<br>rs9479055; rs6931664 |
| 324 | ORF185_6_151443530_151449164_<br>151537463_151538576_FR | C6orf211; CCDC170;<br>RMND1; rs370863743;<br>rs6933660; rs1971256;<br>rs9479055; rs6931664 |
| 325 | ORF185_9_131590628_131592768_<br>131652374_131654389_FF | RAPGEF1; rs4740283;<br>rs11243444 |
| 326 | ORF185_9_131590628_131592768_<br>131652374_131654389_FF | RAPGEF1; rs4740283;<br>rs11243444 |
| 327 | ORF187_9_28314155_28333777_<br>28367003_28368817_FR | LINGO2; rs10812774 |
| 328 | ORF187_9_28314155_28333777_<br>28367003_28368817_FR | LINGO2; rs10812774 |
| 329 | ORF188_2_209095320_209098567_<br>209157796_209164211_RR | MAP2; PTH2R |
| 330 | ORF188_2_209095320_209098567_<br>209157796_209164211_RR | MAP2; PTH2R |
| 331 | ORF19_2_78765449_78768597_<br>78804372_78809080_RF | REG3G |
| 332 | ORF19_2_78765449_78768597_<br>78804372_78809080_RF | REG3G |
| 333 | ORF19_3_107708851_107713617_<br>107779656_107783232_FF | BBX; rs670752;<br>rs11710737; rs6437740 |
| 334 | ORF19_3_107708851_107713617_<br>107779656_107783232_FF | BBX; rs670752;<br>rs11710737; rs6437740 |
| 335 | ORF19_3_24254159_24259126_<br>24306563_24314015_FF | THRB; rs1505297; rs826230;<br>rs826231; rs862247;<br>rs826236; rs826238;<br>rs826240; rs1868575;<br>rs113700287; rs1158265;<br>rs9830674; rs2167115;<br>rs1505307; rs1505283;<br>rs12485694; rs869785;<br>rs869784; rs9310736;<br>rs7622481 |
| 336 | ORF19_3_24254159_24259126_<br>24306563_24314015_FF | THRB; rs1505297; rs826230;<br>rs826231; rs862247;<br>rs826236; rs826238;<br>rs826240; rs1868575;<br>rs113700287; rs1158265;<br>rs9830674; rs2167115;<br>rs1505307; rs1505283;<br>rs12485694; rs869785;<br>rs869784; rs9310736;<br>rs7622481 |
| 337 | ORF19_6_169185535_169187937_<br>169230654_169232256_FR | THBS2; rs9406328 |
| 338 | ORF19_6_169185535_169187937_<br>169230654_169232256_FR | THBS2; rs9406328 |
| 339 | ORF19_8_65560550_65562514_<br>65628655_65630980_FF | ARMC1; rs6991838 |
| 340 | ORF19_8_65560550_65562514_<br>65628655_65630980_FF | ARMC1; rs6991838 |
| 341 | ORF19_8_89905359_89910373_<br>89958362_89963906_FR | NBN; OSGIN2;<br>rs121908973;<br>rs10464867; rs14448;<br>rs13312986; rs1063054;<br>rs2735383; rs142301194;<br>rs1057517262; |

TABLE 1.e1-continued

| | Probe | GeneLocus |
|---|---|---|
| | | rs756363734; rs786204181;<br>rs1064795816; rs730881864;<br>rs730881857; rs786201965;<br>rs775397477; rs1057517075;<br>rs786203223; rs786203920;<br>rs1057516869; rs1061302;<br>rs1057516852; rs587782653;<br>rs1057516668; rs587782545;<br>rs1060503466; rs1377580273;<br>rs1057516611; rs61753717;<br>rs864622143; rs786201745;<br>rs749918573; rs766044684;<br>rs1060503481; rs776417262;<br>rs1057516332; rs1060503480;<br>rs587782344; rs759232053;<br>rs786203180; rs587782130;<br>rs864622333; rs876659666;<br>rs730881850; rs1060503467;<br>rs709816; rs746965070;<br>rs587781969; rs1057519588;<br>rs1057517102; rs1057517209;<br>rs121908974; rs876660290;<br>rs767215758; rs876659521 |
| 342 | ORF19_8_89905359_89910373_<br>89958362_89963906_FR | NBN; OSGIN2; rs121908973;<br>rs10464867; rs14448;<br>rs13312986; rs1063054;<br>rs2735383; rs142301194;<br>rs1057517262; rs756363734;<br>rs786204181; rs1064795816;<br>rs730881864; rs730881857;<br>rs786201965; rs775397477;<br>rs1057517075; rs786203223;<br>rs786203920; rs1057516869;<br>rs1061302; rs1057516852;<br>rs587782653; rs1057516668;<br>rs587782545; rs1060503466;<br>rs1377580273; rs1057516611;<br>rs61753717; rs864622143;<br>rs786201745; rs749918573;<br>rs766044684; rs1060503481;<br>rs776417262; rs1057516332;<br>rs1060503480; rs587782344;<br>rs759232053; rs786203180;<br>rs587782130; rs864622333;<br>rs876659666; rs730881850;<br>rs1060503467; rs709816;<br>rs746965070; rs587781969;<br>rs1057519588; rs1057517102;<br>rs1057517209; rs121908974;<br>rs876660290;<br>rs767215758; rs876659521 |
| 343 | ORF19_9_38681931_38686861_<br>38760727_38762491_FR | ANKRD18A; CNTNAP3 |
| 344 | ORF19_9_38681931_38686861_<br>38760727_38762491_FR | ANKRD18A; CNTNAP3 |
| 345 | ORF190_6_70118659_70128487_<br>70187099_70190406_RF | COL19A1; rs658805;<br>rs771562232 |
| 346 | ORF190_6_70118659_70128487_<br>70187099_70190406_RF | COL19A1; rs658805;<br>rs771562232 |
| 347 | ORF191_10_31830982_31838036_<br>31880198_31881483_FF | ARHGAP12; rs211257 |
| 348 | ORF191_10_31830982_31838036_<br>31880198_31881483_FF | ARHGAP12; rs211257 |
| 349 | ORF191_2_72535662_72545373_<br>72613114_72619302_FR | EXOC6B; rs2421095 |
| 350 | ORF191_2_72535662_72545373_<br>72613114_72619302_FR | EXOC6B; rs2421095 |
| 351 | ORF194_3_24254159_24259126_<br>24306563_24314015_FF | THRB; rs1505297; rs826230;<br>rs826231; rs862247;<br>rs826236; rs826238;<br>rs826240; rs1868575;<br>rs113700287; rs1158265;<br>rs9830674; rs2167115;<br>rs1505307; rs1505283;<br>rs12485694; rs869785;<br>rs869784; rs9310736;<br>rs7622481 |
| 352 | ORF194_3_24254159_24259126_ | THRB; rs1505297; |

TABLE 1.e1-continued

| Probe | GeneLocus |
|---|---|
| 24306563_24314015_FF | rs826230; rs826231; rs862247; rs826236; rs826238; rs826240; rs1868575; rs113700287; rs1158265; rs9830674; rs2167115; rs1505307; rs1505283; rs12485694; rs869785; rs869784; rs9310736; rs7622481 |
| 353 ORF194_5_24638174_24644400_24709728_24712840_RF | CDH10 |
| 354 ORF194_5_24638174_24644400_24709728_24712840_RF | CDH10 |
| 355 ORF194_X_46916544_46918054_46983732_46995250_RR | JADE3; RP2 |
| 356 ORF194_X_46916544_46918054_46983732_46995250_RR | JADE3; RP2 |
| 357 ORF197_19_44168555_44170532_44257710_44261871_RR | ZNF226; ZNF227; ZNF233; ZNF234; ZNF235 |
| 358 ORF197_19_44168555_44170532_44257710_44261871_RR | ZNF226; ZNF227; ZNF233; ZNF234; ZNF235 |
| 359 ORF198_7_7793942_7796470_7867790_7872166_RR | rs17137412; rs37972 |
| 360 ORF198_7_7793942_7796470_7867790_7872166_RR | rs17137412; rs37972 |

TABLE 1.e2

| | Probe_Count_Total | Probe_Count_Sig | HyperG_Stats |
|---|---|---|---|
| 287 | 18 | 3; 3 | 0.026589963; 0.031898647 |
| 288 | 18 | 3; 3 | 0.026589963; 0.031898647 |
| 289 | 68 | 3; 4 | 0.224345313; 0.163371308 |
| 290 | 68 | 3; 4 | 0.224345313; 0.163371308 |
| 291 | 73 | 1; 1 | 0.162201186; 0.138576645 |
| 292 | 73 | 1; 1 | 0.162201186; 0.138576645 |
| 293 | 63; 46; 75 | 3; 5; 2; 4; 3; 5 | 0.216848517; 0.076682692; 0.273777277; 0.084172061; 0.228845362; 0.1125292 |
| 294 | 63; 46; 75 | 3; 5; 2; 4; 3; 5 | 0.216848517; 0.076682692; 0.273777277; 0.084172061; 0.228845362; 0.1125292 |
| 295 | 8; 8 | 1; 1; 1; 1 | 0.236185646; 0.249326315; 0.236185646; 0.249326315 |
| 296 | 8; 8 | 1; 1; 1; 1 | 0.236185646; 0.249326315; 0.236185646; 0.249326315 |
| 297 | 13; 13 | 4; 4; 4; 4 | 0.001148684; 0.001517434; 0.001148684; 0.001517434 |
| 298 | 13; 13 | 4; 4; 4; 4 | 0.001148684; 0.001517434; 0.001148684; 0.001517434 |
| 299 | 54 | 5; 6 | 0.040491239; 0.018151611 |
| 300 | 54 | 5; 6 | 0.040491239; 0.018151611 |
| 301 | 30 | 4; 5 | 0.022454364; 0.006393518 |
| 302 | 30 | 4; 5 | 0.022454364; 0.006393518 |
| 303 | 37; 37 | 5; 8; 5; 8 | 0.010942367; 0.000107113; 0.010942367; 0.000107113 |
| 304 | 37; 37 | 5; 8; 5; 8 | 0.010942367; 0.000107113; 0.010942367; 0.000107113 |
| 305 | 37; 37 | 5; 8; 5; 8 | 0.010942367; 0.000107113; 0.010942367; 0.000107113 |
| 306 | 37; 37 | 5; 8; 5; 8 | 0.010942367; 0.000107113; 0.010942367; 0.000107113 |
| 307 | 52; 32; 49 | 2; 2; 1; 2; 2; 2 | 0.276304155; 0.273929087; 0.363856051; 0.242145801; 0.276096976; 0.276409079 |
| 308 | 52; 32; 49 | 2; 2; 1; 2; 2; 2 | 0.276304155; 0.273929087; 0.363856051; 0.242145801; 0.276096976; 0.276409079 |
| 309 | 21; 8 | 8; 8; 8; 8 | 6.3e−07; 1.12e−06; 5.16e−12; 9.55e−12 |
| 310 | 21; 8 | 8; 8; 8; 8 | 6.3e−07; 1.12e−06; 5.16e−12; 9.55e−12 |
| 311 | 9; 34 | 1; 2; 1; 2 | 0.255358235; 0.047199169; |

TABLE 1.e2-continued

| | Probe_Count_Total | Probe_Count_Sig | HyperG_Stats |
|---|---|---|---|
| | | | 0.357029649; 0.251319324 |
| 312 | 9; 34 | 1; 2; 1; 2 | 0.255358235; 0.047199169; 0.357029649; 0.251319324 |
| 313 | 61; 81 | 2; 3; 3; 3 | 0.26657373; 0.222001213; 0.227770757; 0.222648484 |
| 314 | 61; 81 | 2; 3; 3; 3 | 0.26657373; 0.222001213; 0.227770757; 0.222648484 |
| 315 | NA | NA | NA |
| 316 | NA | NA | NA |
| 317 | 54 | 3; 3 | 0.193670022; 0.206710786 |
| 318 | 54 | 3; 3 | 0.193670022; 0.206710786 |
| 319 | 33 | 4; 2 | 0.029769861; 0.246924146 |
| 320 | 33 | 4; 2 | 0.029769861; 0.246924146 |
| 321 | NA | NA | NA |
| 322 | NA | NA | NA |
| 323 | 63; 46; 75 | 3; 5; 2; 4; 3; 5 | 0.216848517; 0.076682692; 0.273777277; 0.084172061; 0.228845362; 0.1125292 |
| 324 | 63; 46; 75 | 3; 5; 2; 4; 3; 5 | 0.216848517; 0.076682692; 0.273777277; 0.084172061; 0.228845362; 0.1125292 |
| 325 | 65 | 2; 2 | 0.258408092; 0.245566966 |
| 326 | 65 | 2; 2 | 0.258408092; 0.245566966 |
| 327 | 20 | 6; 4 | 7.69e−05; 0.007618647 |
| 328 | 20 | 6; 4 | 7.69e−05; 0.007618647 |
| 329 | 60; 1 | 5; 7; 1; 1 | 0.05512946; 0.009185497; 0.038988153; 0.042102538 |
| 330 | 60; 1 | 5; 7; 1; 1 | 0.05512946; 0.009185497; 0.038988153; 0.042102538 |
| 331 | 3 | 3; 2 | 0; 0.001770535 |
| 332 | 3 | 3; 2 | 0; 0.001770535 |
| 333 | 30 | 4; 5 | 0.022454364; 0.006393518 |
| 334 | 30 | 4; 5 | 0.022454364; 0.006393518 |
| 335 | 14 | 3; 2 | 0.013899641; 0.096260668 |
| 336 | 14 | 3; 2 | 0.013899641; 0.096260668 |
| 337 | 46 | 2; 3 | 0.273777277; 0.178397403 |
| 338 | 46 | 2; 3 | 0.273777277; 0.178397403 |
| 339 | 48 | 5; 4 | 0.02780594; 0.092112824 |
| 340 | 48 | 5; 4 | 0.02780594; 0.092112824 |
| 341 | 11; 14 | 1; 1; 1; 2 | 0.288260522; 0.301350316; 0.325643034; 0.096260668 |
| 342 | 11; 14 | 1; 1; 1; 2 | 0.288260522; 0.301350316; 0.325643034; 0.096260668 |
| 343 | 21; 8 | 8; 8; 8; 8 | 6.3e−07; 1.12e−06; 5.16e−12; 9.55e−12 |
| 344 | 21;8 | 8; 8; 8; 8 | 6.3e−07; 1.12e−06; 5.16e−12; 9.55e−12 |
| 345 | 18 | 3; 3 | 0.026589963; 0.031898647 |
| 346 | 18 | 3; 3 | 0.026589963; 0.031898647 |
| 347 | 12 | 1; 1 | 0.302214299; 0.314913912 |
| 348 | 12 | 1; 1 | 0.302214299; 0.314913912 |
| 349 | 20 | 1; 1 | 0.366490901; 0.372098641 |
| 350 | 20 | 1; 1 | 0.366490901; 0.372098641 |
| 351 | 14 | 3; 2 | 0.013899641; 0.096260668 |
| 352 | 14 | 3; 2 | 0.013899641; 0.096260668 |
| 353 | 13 | 1; 1 | 0.314642613; 0.32680192 |
| 354 | 13 | 1; 1 | 0.314642613; 0.32680192 |
| 355 | 17; 3 | 1; 1; 1; 1 | 0.350975055; 0.359834557; 0.108032075; 0.115907508 |
| 356 | 17; 3 | 1; 1; 1; 1 | 0.350975055; 0.359834557; 0.108032075; 0.115907508 |
| 357 | 7; 10; 10; 4; 10 | 1; 1; 1; 1; 1; 1; 1; 1; 1; 1 | 0.215038813; 0.227740664; 0.272678156; 0.285987033; 0.272678156; 0.285987033; 0.138432982; 0.14804367; 0.272678156; 0.285987033 |
| 358 | 7; 10; 10; 4; 10 | 1; 1; 1; 1; 1; 1; 1; 1; 1; 1 | 0.215038813; 0.227740664; 0.272678156; 0.285987033; 0.272678156; 0.285987033; 0.138432982; 0.14804367; 0.272678156; 0.285987033 |
| 359 | NA | NA | NA |
| 360 | NA | NA | NA |

| | FDR_HyperG | Percent_Sig | logFC | AveExpr |
|---|---|---|---|---|
| 287 | 0.375519541; 0.376115439 | 16.67; 16.67 | 0.743060399 | 0.743060399 |
| 288 | 0.375519541; 0.376115439 | 16.67; 16.67 | 0.69286775 | 0.69286775 |
| 289 | 0.375519541; 0.376115439 | 4.41; 5.88 | 0.572881601 | 0.572881601 |
| 290 | 0.375519541; 0.376115439 | 4.41; 5.88 | 0.554041986 | 0.554041986 |
| 291 | 0.375519541; 0.376115439 | 1.37; 1.37 | 0.847472811 | 0.847472811 |
| 292 | 0.375519541; 0.376115439 | 1.37; 1.37 | 0.826205454 | 0.826205454 |
| 293 | 0.375519541; 0.376115439; 0.375519541; 0.376115439; 0.375519541; 0.376115439 | 4.76; 7.94; 4.35; 8.7; 4; 6.67 | 0.546916456 | 0.546916456 |
| 294 | 0.375519541; 0.376115439; 0.375519541; 0.376115439; 0.375519541; 0.376115439 | 4.76; 7.94; 4.35; 8.7; 4; 6.67 | 0.535096369 | 0.535096369 |
| 295 | 0.375519541; 0.376115439; 0.375519541; 0.376115439 | 12.5; 12.5; 12.5; 12.5 | 0.676303004 | 0.676303004 |
| 296 | 0.375519541; 0.376115439; 0.375519541; 0.376115439 | 12.5; 12.5; 12.5; 12.5 | 0.533842136 | 0.533842136 |
| 297 | 0.069549998; 0.082088441; 0.069549998; 0.082088441 | 30.77; 30.77; 30.77; 30.77 | 0.608450973 | 0.608450973 |
| 298 | 0.069549998; 0.082088441; 0.069549998; 0.082088441 | 30.77; 30.77; 30.77; 30.77 | 0.52321187 | 0.52321187 |
| 299 | 0.375519541; 0.376115439 | 9.26; 11.11 | 0.843438189 | 0.843438189 |
| 300 | 0.375519541; 0.376115439 | 9.26; 11.11 | 0.825036898 | 0.825036898 |
| 301 | 0.375519541; 0.217379602 | 13.33; 16.67 | 0.519816137 | 0.519816137 |
| 302 | 0.375519541; 0.217379602 | 13.33; 16.67 | 0.518513646 | 0.518513646 |
| 303 | 0.357678624; 0.013656923; 0.357678624; 0.013656923 | 13.51; 21.62; 13.51; 21.62 | 0.616631247 | 0.616631247 |
| 304 | 0.357678624; 0.013656923; 0.357678624; 0.013656923 | 13.51; 21.62; 13.51; 21.62 | 0.578396959 | 0.578396959 |
| 305 | 0.357678624; 0.013656923; 0.357678624; 0.013656923 | 13.51; 21.62; 13.51; 21.62 | 0.791519135 | 0.791519135 |
| 306 | 0.357678624; 0.013656923; 0.357678624; 0.013656923 | 13.51; 21.62; 13.51; 21.62 | 0.69245514 | 0.69245514 |
| 307 | 0.375519541; 0.376115439; 0.375519541; 0.376115439; 0.375519541; 0.376115439 | 3.85; 3.85; 3.12; 6.25; 4.08; 4.08 | 0.701431344 | 0.701431344 |
| 308 | 0.375519541; 0.376115439; 0.375519541; 0.376115439; 0.375519541; 0.376115439 | 3.85; 3.85; 3.12; 6.25; 4.08; 4.08 | 0.658724646 | 0.658724646 |
| 309 | 0.000109745; 0.00028483; 1.35e−09; 4.87e−09 | 38.1; 38.1; 100; 100 | 0.694869829 | 0.694869829 |
| 310 | 0.000109745; 0.00028483; 1.35e−09; 4.87e−09 | 38.1; 38.1; 100; 100 | 0.571266171 | 0.571266171 |
| 311 | 0.375519541; 0.376115439; 0.375519541; 0.376115439 | 11.11; 22.22; 2.94; 5.88 | 0.682462284 | 0.682462284 |
| 312 | 0.375519541; 0.376115439; 0.375519541; 0.376115439 | 11.11; 22.22; 2.94; 5.88 | 0.609898655 | 0.609898655 |
| 313 | 0.375519541; 0.376115439; 0.375519541; 0.376115439 | 3.28; 4.92; 3.7; 3.7 | 0.875323772 | 0.875323772 |
| 314 | 0.375519541; 0.376115439; 0.375519541; 0.376115439 | 3.28; 4.92; 3.7; 3.7 | 0.803435131 | 0.803435131 |
| 315 | NA | NA | 0.593346815 | 0.593346815 |
| 316 | NA | NA | 0.499638042 | 0.499638042 |
| 317 | 0.375519541; 0.376115439 | 5.56; 5.56 | 0.934419976 | 0.934419976 |
| 318 | 0.375519541; 0.376115439 | 5.56; 5.56 | 0.841538744 | 0.841538744 |
| 319 | 0.375519541; 0.376115439 | 12.12; 6.06 | 0.6441859 | 0.6441859 |
| 320 | 0.375519541; 0.376115439 | 12.12; 6.06 | 0.589681807 | 0.589681807 |
| 321 | NA | NA | 0.698803831 | 0.698803831 |
| 322 | NA | NA | 0.561454343 | 0.561454343 |
| 323 | 0.375519541; 0.376115439; 0.375519541; 0.376115439; 0.375519541; 0.376115439 | 4.76; 7.94; 4.35; 8.7; 4; 6.67 | 0.506604445 | 0.506604445 |
| 324 | 0.375519541; 0.376115439; 0.375519541; 0.376115439; 0.375519541; 0.376115439 | 4.76; 7.94; 4.35; 8.7; 4; 6.67 | 0.494121362 | 0.494121362 |
| 325 | 0.375519541; 0.376115439 | 3.08; 3.08 | 0.731953563 | 0.731953563 |
| 326 | 0.375519541; 0.376115439 | 3.08; 3.08 | 0.654724778 | 0.654724778 |
| 327 | 0.008046243; 0.242844385 | 30; 20 | 0.843775275 | 0.843775275 |
| 328 | 0.008046243; 0.242844385 | 30; 20 | 0.684458116 | 0.684458116 |
| 329 | 0.375519541; 0.275564898; 0.375519541; 0.376115439 | 8.33; 11.67; 100; 100 | 0.870854788 | 0.870854788 |
| 330 | 0.375519541; 0.275564898; 0.375519541; 0.376115439 | 8.33; 11.67; 100; 100 | 0.686466545 | 0.686466545 |
| 331 | 0; 0.082088441 | 100; 100 | 0.534288724 | 0.534288724 |
| 332 | 0; 0.082088441 | 100; 100 | 0.519928663 | 0.519928663 |
| 333 | 0.375519541; 0.217379602 | 13.33; 16.67 | 0.610561918 | 0.610561918 |
| 334 | 0.375519541; 0.217379602 | 13.33; 16.67 | 0.564884491 | 0.564884491 |
| 335 | 0.375519541; 0.376115439 | 21.43; 14.29 | 0.574528501 | 0.574528501 |
| 336 | 0.375519541; 0.376115439 | 21.43; 14.29 | 0.53282889 | 0.53282889 |
| 337 | 0.375519541; 0.376115439 | 4.35; 6.52 | 0.796010876 | 0.796010876 |
| 338 | 0.375519541; 0.376115439 | 4.35; 6.52 | 0.739967602 | 0.739967602 |
| 339 | 0.375519541; 0.376115439 | 10.42; 8.33 | 0.516922094 | 0.516922094 |
| 340 | 0.375519541; 0.376115439 | 10.42; 8.33 | 0.515009153 | 0.515009153 |
| 341 | 0.375519541; 0.376115439; 0.375519541; 0.376115439 | 9.09; 9.09; 7.14; 14.29 | 0.537064279 | 0.537064279 |
| 342 | 0.375519541; 0.376115439; 0.375519541; 0.376115439 | 9.09; 9.09; 7.14; 14.29 | 0.534110975 | 0.534110975 |
| 343 | 0.000109745; 0.00028483; 1.35e−09; 4.87e−09 | 38.1; 38.1; 100; 100 | 0.688184297 | 0.688184297 |
| 344 | 0.000109745; 0.00028483; 1.35e−09; 4.87e−09 | 38.1; 38.1; 100; 100 | 0.561280923 | 0.561280923 |
| 345 | 0.375519541; 0.376115439 | 16.67; 16.67 | 0.6396234 | 0.6396234 |
| 346 | 0.375519541; 0.376115439 | 16.67; 16.67 | 0.62977534 | 0.62977534 |
| 347 | 0.375519541; 0.376115439 | 8.33; 8.33 | 0.797414414 | 0.797414414 |
| 348 | 0.375519541; 0.376115439 | 8.33; 8.33 | 0.712359797 | 0.712359797 |
| 349 | 0.375519541; 0.376115439 | 5; 5 | 0.575759347 | 0.575759347 |
| 350 | 0.375519541; 0.376115439 | 5; 5 | 0.49258676 | 0.49258676 |
| 351 | 0.375519541; 0.376115439 | 21.43; 14.29 | 0.565428207 | 0.565428207 |
| 352 | 0.375519541; 0.376115439 | 21.43; 14.29 | 0.529609408 | 0.529609408 |
| 353 | 0.375519541; 0.376115439 | 7.69; 7.69 | 0.554546607 | 0.554546607 |
| 354 | 0.375519541; 0.376115439 | 7.69; 7.69 | 0.528816642 | 0.528816642 |
| 355 | 0.375519541; 0.376115439; 0.375519541; 0.376115439 | 5.88; 5.88; 33.33; 33.33 | 0.703969549 | 0.703969549 |
| 356 | 0.375519541; 0.376115439; 0.375519541; 0.376115439; 0.375519541; 0.376115439; 0.375519541; 0.376115439 | 5.88; 5.88; 33.33; 33.33 | 0.676506328 | 0.676506328 |
| 357 | 0.375519541; 0.376115439; 0.375519541; 0.376115439 | 14.29; 14.29; 10; 10; 10; 10; 25; 25; 10; 10 | 0.688148639 | 0.688148639 |
| 358 | 0.375519541; 0.376115439; 0.375519541; 0.376115439; 0.375519541; 0.376115439; 0.375519541; 0.376115439; 0.375519541; 0.376115439 | 14.29; 14.29; 10; 10; 10; 10; 25; 25; 10; 10 | 0.659914521 | 0.659914521 |
| 359 | NA | NA | 0.671202878 | 0.671202878 |
| 360 | NA | NA | 0.575613955 | 0.575613955 |

TABLE 1.e4

| | T | P. Value | adj. P. Val | B | FC | FC_1 | LS |
|---|---|---|---|---|---|---|---|
| 287 | 14.79804494 | 0.00000000485 | 0.00000387 | 11.28467862 | 1.673722555 | 1.673722555 | 1 |
| 288 | 17.82482686 | 0.000000000545 | 0.000000726 | 13.3989763 | 1.616493549 | 1.616493549 | 1 |
| 289 | 12.91122911 | 0.0000000226 | 0.00000847 | 9.814824696 | 1.487491682 | 1.487491682 | 1 |
| 290 | 11.21353517 | 0.000000104 | 0.00001 | 8.301902675 | 1.468193363 | 1.468193363 | 1 |
| 291 | 12.15769748 | 0.0000000442 | 0.000012 | 9.162175379 | 1.799346224 | 1.799346224 | 1 |
| 292 | 7.763755476 | 0.00000515 | 0.000113029 | 4.321223889 | 1.773015875 | 1.773015875 | 1 |
| 293 | 11.40568259 | 0.0000000895 | 0.0000173 | 8.468302773 | 1.460959775 | 1.460959775 | 1 |
| 294 | 8.861237956 | 0.00000132 | 0.0000474 | 5.724536025 | 1.449038944 | 1.449038944 | 1 |
| 295 | 9.499895126 | 0.000000629 | 0.0000299 | 6.478297904 | 1.598039428 | 1.598039428 | 1 |
| 296 | 5.637118565 | 0.000111697 | 0.001574022 | 1.229130688 | 1.447779744 | 1.447779744 | 1 |
| 297 | 12.54327613 | 0.0000000312 | 0.00000985 | 9.501226666 | 1.524621338 | 1.524621338 | 1 |
| 298 | 19.75351316 | 0.000000000165 | 0.000000477 | 14.48625207 | 1.437151217 | 1.437151217 | 1 |
| 299 | 20.82530404 | 0.0000000000891 | 0.00000039 | 15.03420497 | 1.794321224 | 1.794321224 | 1 |
| 300 | 12.16144032 | 0.000000044 | 0.000012 | 9.165519416 | 1.771580348 | 1.771580348 | 1 |
| 301 | 15.50410556 | 0.00000000272 | 0.00000148 | 11.88695557 | 1.43377251 | 1.43377251 | 1 |
| 302 | 11.43283696 | 0.0000000872 | 0.000017 | 8.4941417 | 1.432478659 | 1.432478659 | 1 |
| 303 | 8.091251762 | 0.00000346 | 0.000162025 | 4.791306687 | 1.5332907 | 1.5332907 | 1 |
| 304 | 8.889858739 | 0.00000127 | 0.0000463 | 5.759261158 | 1.49318918 | 1.49318918 | 1 |
| 305 | 13.0614879 | 0.0000000198 | 0.00000792 | 9.940188169 | 1.73089611 | 1.73089611 | 1 |
| 306 | 10.13449544 | 0.000000314 | 0.0000195 | 7.185647609 | 1.616031299 | 1.616031299 | 1 |
| 307 | 17.12053769 | 0.0000000000868 | 0.000000895 | 12.96563906 | 1.626117316 | 1.626117316 | 1 |
| 308 | 11.67800798 | 0.000000069 | 0.0000149 | 8.724725184 | 1.578686435 | 1.578686435 | 1 |
| 309 | 5.377075419 | 0.000169218 | 0.002110359 | 0.802297875 | 1.618738371 | 1.618738371 | 1 |
| 310 | 6.099949932 | 0.0000537 | 0.00053451 | 1.899523005 | 1.485827024 | 1.485827024 | 1 |
| 311 | 10.21023183 | 0.00000029 | 0.0000186 | 7.267445548 | 1.604876502 | 1.604876502 | 1 |
| 312 | 7.117148255 | 0.0000125 | 0.000365074 | 3.475653858 | 1.526151997 | 1.526151997 | 1 |
| 313 | 17.54374798 | 0.000000000691 | 0.00000167 | 13.07787093 | 1.834419723 | 1.834419723 | 1 |
| 314 | 20.65930634 | 0.0000000000979 | 0.00000039 | 14.95175502 | 1.745251717 | 1.745251717 | 1 |
| 315 | 13.88146564 | 0.0000000001 | 0.0000055 | 10.59810905 | 1.508742726 | 1.508742726 | 1 |
| 316 | 5.926104266 | 0.0000701 | 0.000645984 | 1.62438742 | 1.413858794 | 1.413858794 | 1 |
| 317 | 11.34417863 | 0.0000000916 | 0.00000932 | 8.430204079 | 1.911122129 | 1.911122129 | 1 |
| 318 | 12.89386645 | 0.0000000229 | 0.00000857 | 9.80023923 | 1.791960385 | 1.791960385 | 1 |
| 319 | 8.682862194 | 0.00000167 | 0.000102493 | 5.532697246 | 1.562857131 | 1.562857131 | 1 |
| 320 | 10.89680686 | 0.000000143 | 0.0000122 | 7.984904648 | 1.504914795 | 1.504914795 | 1 |
| 321 | 5.568028354 | 0.000124615 | 0.001702064 | 1.116657177 | 1.62315844 | 1.62315844 | 1 |
| 322 | 4.050545041 | 0.001613641 | 0.006367669 | −1.601006161 | 1.475756139 | 1.475756139 | 1 |
| 323 | 17.28762581 | 0.000000000819 | 0.0000018 | 12.92544124 | 1.420702465 | 1.420702465 | 1 |
| 324 | 10.55306209 | 0.000000202 | 0.0000151 | 7.63102272 | 1.408462704 | 1.408462704 | 1 |
| 325 | 13.01763676 | 0.0000000206 | 0.00000805 | 9.903761182 | 1.660886588 | 1.660886588 | 1 |
| 326 | 9.195548619 | 0.00000089 | 0.0000372 | 6.124544214 | 1.574315593 | 1.574315593 | 1 |
| 327 | 12.02519226 | 0.0000000499 | 0.0000126 | 9.043107691 | 1.794740517 | 1.794740517 | 1 |
| 328 | 13.3734662 | 0.0000000146 | 0.00000347 | 10.25629174 | 1.607098233 | 1.607098233 | 1 |
| 329 | 11.57704591 | 0.000000076 | 0.0000158 | 8.630357322 | 1.828746101 | 1.828746101 | 1 |
| 330 | 9.119712318 | 0.000000971 | 0.0000394 | 6.034870076 | 1.609337092 | 1.609337092 | 1 |
| 331 | 11.89618574 | 0.0000000541 | 0.00000692 | 8.957125961 | 1.448227974 | 1.448227974 | 1 |
| 332 | 9.888133631 | 0.000000423 | 0.0000439 | 6.921798706 | 1.433884345 | 1.433884345 | 1 |
| 333 | 10.93247539 | 0.000000142 | 0.0000229 | 8.008110873 | 1.52685379 | 1.52685379 | 1 |
| 334 | 7.477823387 | 0.00000752 | 0.000143556 | 3.931392434 | 1.479269067 | 1.479269067 | 1 |
| 335 | 12.4790638 | 0.0000000317 | 0.00000524 | 9.488168688 | 1.489190689 | 1.489190689 | 1 |
| 336 | 13.34668647 | 0.0000000156 | 0.00000697 | 10.17396116 | 1.446763284 | 1.446763284 | 1 |
| 337 | 6.818288352 | 0.000019 | 0.000483128 | 3.046799664 | 1.736293544 | 1.736293544 | 1 |
| 338 | 4.346150204 | 0.000954612 | 0.004295132 | −1.065051949 | 1.670138332 | 1.670138332 | 1 |
| 339 | 9.051835894 | 0.00000105 | 0.0000413 | 5.954082233 | 1.430899249 | 1.430899249 | 1 |
| 340 | 6.535333442 | 0.0000286 | 0.000631898 | 2.62938138 | 1.429003206 | 1.429003206 | 1 |
| 341 | 12.02753101 | 0.0000000498 | 0.0000126 | 9.045220814 | 1.451016857 | 1.451016857 | 1 |
| 342 | 13.77879282 | 0.0000000104 | 0.00000291 | 10.58706514 | 1.448049555 | 1.448049555 | 1 |
| 343 | 5.570795634 | 0.000124068 | 0.001696213 | 1.121175096 | 1.611254399 | 1.611254399 | 1 |
| 344 | 5.819089703 | 0.0000827 | 0.000723642 | 1.452893167 | 1.475578755 | 1.475578755 | 1 |
| 345 | 10.99347808 | 0.000000129 | 0.0000114 | 8.082564002 | 1.557922427 | 1.557922427 | 1 |
| 346 | 7.291733847 | 0.00000988 | 0.00031393 | 3.720569026 | 1.547324022 | 1.547324022 | 1 |
| 347 | 16.34689112 | 0.00000000148 | 0.00000114 | 12.4647108 | 1.737983534 | 1.737983534 | 1 |
| 348 | 13.135413 | 0.0000000186 | 0.0000077 | 10.00130376 | 1.638481969 | 1.638481969 | 1 |
| 349 | 13.36085973 | 0.0000000154 | 0.00000694 | 10.18543862 | 1.490461745 | 1.490461745 | 1 |
| 350 | 6.954716167 | 0.0000154 | 0.00023183 | 3.190545206 | 1.406965312 | 1.406965312 | 1 |
| 351 | 12.60506746 | 0.0000000284 | 0.00000497 | 9.599712317 | 1.479826672 | 1.479826672 | 1 |
| 352 | 12.62371363 | 0.0000000291 | 0.00000947 | 9.570596966 | 1.443538322 | 1.443538322 | 1 |
| 353 | 14.39806455 | 0.00000000662 | 0.00000459 | 10.99110447 | 1.468706993 | 1.468706993 | 1 |
| 354 | 11.91678031 | 0.0000000531 | 0.00000684 | 8.976322614 | 1.442745311 | 1.442745311 | 1 |
| 355 | 9.495063948 | 0.000000652 | 0.000057 | 6.485669588 | 1.628980743 | 1.628980743 | 1 |
| 356 | 8.676700215 | 0.00000164 | 0.0000546 | 5.498436395 | 1.598264661 | 1.598264661 | 1 |
| 357 | 14.34994802 | 0.00000000687 | 0.00000467 | 10.95516949 | 1.611214575 | 1.611214575 | 1 |
| 358 | 10.42711402 | 0.000000231 | 0.0000162 | 7.498711132 | 1.579989008 | 1.579989008 | 1 |
| 359 | 8.231730658 | 0.0000029 | 0.000144892 | 4.971137159 | 1.592400111 | 1.592400111 | 1 |
| 360 | 14.99572789 | 0.00000000398 | 0.00000178 | 11.52107107 | 1.490311547 | 1.490311547 | 1 |

TABLE 1.e5

| | Loop Detected | Probe sequence 60 mer | Probe Location Chr |
|---|---|---|---|
| 287 | mHC | AAAATCAGTTAATTGGAATTAATATAATTCGATTACTGAAGAGTCCATTAGAGTAAGCAG (SEQ ID NO: 860) | 6 |
| 288 | sHC | AAAATCAGTTAATTGGAATTAATATAATTCGATTACTGAAGAGTCCATTAGAGTAAGCAG (SEQ ID NO: 860) | 6 |
| 289 | mHC | CTAAGCAGAGACTAAGAATATCTTAAAGTCGATTTTATTTTTTTTTAAGGATCTGTTACA (SEQ ID NO: 862) | 4 |
| 290 | sHC | CTAAGCAGAGACTAAGAATATCTTAAAGTCGATTTTATTTTTTTTTAAGGATCTGTTACA (SEQ ID NO: 862) | 4 |
| 291 | mHC | TTTTATATGTTTAACAGAATAGTATATATCGAAACTGGTTTATGTATAAAATATTAGGAC (SEQ ID NO: 864) | 6 |
| 292 | sHC | TTTTATATGTTTAACAGAATAGTATATATCGAAACTGGTTTATGTATAAAATATTAGGAC (SEQ ID NO: 864) | 6 |
| 293 | mHC | GAGGCGGGTGATTCACAAGGTCAGATGTTCGATTTGGGTATATCTAATGTTTTCTCATGA (SEQ ID NO: 866) | 6 |
| 294 | sHC | GAGGCGGGTGATTCACAAGGTCAGATGTTCGATTTGGGTATATCTAATGTTTTCTCATGA (SEQ ID NO: 866) | 6 |
| 295 | sHC | GCTGATTGTTGCTATATTGGAATTTGGATCGAATTTATTGGCATATAATTGTTCATAGCA (SEQ ID NO: 868) | X |
| 296 | mHC | GCTGATTGTTGCTATATTGGAATTTGGATCGAATTTATTGGCATATAATTGTTCATAGCA (SEQ ID NO: 868) | X |
| 297 | mHC | AAGAATATCATCCTGGAAGTTAGGAAATTCGAGTAGCTATCTGTTTCTTCTATATCTAAA (SEQ ID NO: 870) | 12 |
| 298 | sHC | AAGAATATCATCCTGGAAGTTAGGAAATTCGAGTAGCTATCTGTTTCTTCTATATCTAAA (SEQ ID NO: 870) | 12 |
| 299 | sHC | TATATGGTACATATTATACATATTTCTATCGATCTCATTTGTCCATTTGCAAATGGAAAC (SEQ ID NO: 872) | 2 |
| 300 | mHC | TATATGGTACATATTATACATATTTCTATCGATCTCATTTGTCCATTTGCAAATGGAAAC (SEQ ID NO: 872) | 2 |
| 301 | sHC | TTGAAACTTTAACTCTGTCAAGATGTTATCGAAGGTATCAATATCTGTGTAGTTGTATGA (SEQ ID NO: 874) | 3 |
| 302 | mHC | TTGAAACTTTAACTCTGTCAAGATGTTATCGAAGGTATCAATATCTGTGTAGTTGTATGA (SEQ ID NO: 874) | 3 |
| 303 | mHC | CCTACCAGAACTCTTAAATCTATAATATTCGATTCTTGATTAAATAATCTTTTATTTTCA (SEQ ID NO: 876) | 4 |
| 304 | sHC | CCTACCAGAACTCTTAAATCTATAATATTCGATTCTTGATTAAATAATCTTTTATTTTCA (SEQ ID NO: 876) | 4 |
| 305 | mHC | TGAAAATAAAAGATTATTTAATCAAGAATCGATATATTCTACAAACTGCTTTATTGTAGA (SEQ ID NO: 878) | 4 |
| 306 | sHC | TGAAAATAAAAGATTATTTAATCAAGAATCGATATATTCTACAAACTGCTTTATTGTAGA (SEQ ID NO: 878) | 4 |
| 307 | sHC | TATAAGACAGTAATTTCAGAATTACTGTTCGATTAGCACTGATTTTGAATGTTTCAAAAG (SEQ ID NO: 880) | 8 |
| 308 | mHC | TATAAGACAGTAATTTCAGAATTACTGTTCGATTAGCACTGATTTTGAATGTTTCAAAAG (SEQ ID NO: 880) | 8 |
| 309 | mHC | CCACGGAGGGGTCCTTCTGAACTGCAATTCGATACAGGTATGCAAGTTCTTATTTTTTGT (SEQ ID NO: 882) | 9 |
| 310 | sHC | CCACGGAGGGGTCCTTCTGAACTGCAATTCGATACAGGTATGCAAGTTCTTATTTTTTGT (SEQ ID NO: 882) | 9 |
| 311 | sHC | ATTAAATATAACCTATTATCCTTATCACTCGAGAAAAGTCTGAACTAAATCTGTTAAGGT (SEQ ID NO: 884) | X |
| 312 | mHC | ATTAAATATAACCTATTATCCTTATCACTCGAGAAAAGTCTGAACTAAATCTGTTAAGGT | X |

TABLE 1.e5-continued

| Loop Detected | Probe sequence 60 mer | Probe Location Chr |
|---|---|---|
| | (SEQ ID NO: 884) | |
| 313 mHC | ATTTTTAATTATTAAAAAATAATGTTTTTCGACAGGTTAAGGATAAAGAGAAAATATTAA (SEQ ID NO: 886) | 2 |
| 314 sHC | ATTTTTAATTATTAAAAAATAATGTTTTTCGACAGGTTAAGGATAAAGAGAAAATATTAA (SEQ ID NO: 886) | 2 |
| 315 mHC | AGGTAATTAAGACAAGAAAGACATTTATTCGATATACATTCTTTGTACTTATTGTTGATA (SEQ ID NO: 888) | 2 |
| 316 sHC | AGGTAATTAAGACAAGAAAGACATTTATTCGATATACATTCTTTGTACTTATTGTTGATA (SEQ ID NO: 888) | 2 |
| 317 sHC | GTCATAAAATATTACCAGAAAAGCATATTCGAACTCTTTATATTCTTTTATATTTTCATA (SEQ ID NO: 890) | 7 |
| 318 mHC | GTCATAAAATATTACCAGAAAAGCATATTCGAACTCTTTATATTCTTTTATATTTTCATA (SEQ ID NO: 890) | 7 |
| 319 mHC | CGTAATGTTATTTTTAAAAACGTACTTTTCGATGTCTAATGAGACAGTGGAATTCTACTT (SEQ ID NO: 892) | 18 |
| 320 sHC | CGTAATGTTATTTTTAAAAACGTACTTTTCGATGTCTAATGAGACAGTGGAATTCTACTT (SEQ ID NO: 892) | 18 |
| 321 mHC | AAGTTTTTTTTCGCTATAGTTACAGTACTCGAATTGGGTGATTTGAGTAGAGTTTAATCA (SEQ ID NO: 894) | 4 |
| 322 sHC | AAGTTTTTTTTCGCTATAGTTACAGTACTCGAATTGGGTGATTTGAGTAGAGTTTAATCA (SEQ ID NO: 894) | 4 |
| 323 mHC | GAGGCGGGTGATTCACAAGGTCAGATGTTCGATATCACAGAACTCATAAAAGTTAAAATG (SEQ ID NO: 896) | 6 |
| 324 sHC | GAGGCGGGTGATTCACAAGGTCAGATGTTCGATATCACAGAACTCATAAAAGTTAAAATG (SEQ ID NO: 896) | 6 |
| 325 mHC | TTTTAAATTTTTATTATGATTATTATTTTCGATTAATAAGATGTTTTCAGACACTGGAAC (SEQ ID NO: 898) | 9 |
| 326 sHC | TTTTAAATTTTTATTATGATTATTATTTTCGATTAATAAGATGTTTTCAGACACTGGAAC (SEQ ID NO: 898) | 9 |
| 327 mHC | AAAGTCATACAACTACTATGTAAGATATTCGATTTCCCACATGGAATATACAGATTTAGC (SEQ ID NO: 900) | 9 |
| 328 sHC | AAAGTCATACAACTACTATGTAAGATATTCGATTTCCCACATGGAATATACAGATTTAGC (SEQ ID NO: 900) | 9 |
| 329 mHC | ACAGAATTAAATTGTATGTCAAGTTACTTCGAAAGGTCTTTCTAGTGATACATTTAAACT (SEQ ID NO: 902) | 2 |
| 330 sHC | ACAGAATTAAATTGTATGTCAAGTTACTTCGAAAGGTCTTTCTAGTGATACATTTAAACT (SEQ ID NO: 902) | 2 |
| 331 sHC | AGATGATAAACAATGCATTTGGAATATATCGATTTTAAATTTATTCCTAATTTCTAAGGT (SEQ ID NO: 904) | 2 |
| 332 mHC | AGATGATAAACAATGCATTTGGAATATATCGATTTTAAATTTATTCCTAATTTCTAAGGT (SEQ ID NO: 904) | 2 |
| 333 mHC | TTACATTAAATAGCAATTAAAACATTTTTCGAAAACAAATAGATAAGATTTAATTGTAGT (SEQ ID NO: 906) | 3 |
| 334 sHC | TTACATTAAATAGCAATTAAAACATTTTTCGAAAACAAATAGATAAGATTTAATTGTAGT (SEQ ID NO: 906) | 3 |
| 335 sHC | AACTCTTCCATAAAGATTTATCAAAAATTCGAAAAGAAGAACAAGAAAAAGCCTAATTCC (SEQ ID NO: 908) | 3 |
| 336 mHC | AACTCTTCCATAAAGATTTATCAAAAATTCGAAAAGAAGAACAAGAAAAAGCCTAATTCC (SEQ ID NO: 908) | 3 |
| 337 mHC | TTAAAAAAGATTTAAAAAGTCAAAAGAGTCGAAGTTATTAAAATTTCCATCTAAAATTCCA (SEQ ID NO: 910) | 6 |

TABLE 1.e5-continued

| | Loop Detected | Probe sequence 60 mer | Probe Location Chr |
|---|---|---|---|
| 338 | sHC | TTAAAAAAGATTTAAAAAGTCAAAAGAGTCGAAGTTATTAAATTTCCATCTAAAATTCCA (SEQ ID NO: 910) | 6 |
| 339 | sHC | TATCTCTATGTAATAATCACTAAAAGTATCGAAAATACTGTACAATAGTCTCAGGATTTG (SEQ ID NO: 912) | 8 |
| 340 | mHC | TATCTCTATGTAATAATCACTAAAAGTATCGAAAATACTGTACAATAGTCTCAGGATTTG (SEQ ID NO: 912) | 8 |
| 341 | mHC | ATGTATATTTTTCATCTAATATACAAAGTCGATGTTCACACAATGCCAAAATTGTGTAAG (SEQ ID NO: 914) | 8 |
| 342 | sHC | ATGTATATTTTTCATCTAATATACAAAGTCGATGTTCACACAATGCCAAAATTGTGTAAG (SEQ ID NO: 914) | 8 |
| 343 | mHC | CCACGGAGGGGTCCTTCTGAACTGCAATTCGATTAGTGGTTATTTTATTTCTATAATTTC (SEQ ID NO: 916) | 9 |
| 344 | sHC | CCACGGAGGGGTCCTTCTGAACTGCAATTCGATTAGTGGTTATTTTATTTCTATAATTTC (SEQ ID NO: 916) | 9 |
| 345 | sHC | TGAAGGTTAGATTTTCTTAATAACATTTTCGAGTACTACTTTGAAGATAAGACATTTTGT (SEQ ID NO: 918) | 6 |
| 346 | mHC | TGAAGGTTAGATTTTCTTAATAACATTTTCGAGTACTACTTTGAAGATAAGACATTTTGT (SEQ ID NO: 918) | 6 |
| 347 | sHC | ATAAATAATGACAAGTTATTTTATGTAATCGAGACCCCTCAAAAGATATTTTCAGACTTT (SEQ ID NO: 920) | 10 |
| 348 | mHC | ATAAATAATGACAAGTTATTTTATGTAATCGAGACCCCTCAAAAGATATTTTCAGACTTT (SEQ ID NO: 920) | 10 |
| 349 | mHC | GAAGTATTTCATTTAAAAAAAAATCAAATCGATGTATTTTTTGACTTAATGATCAGTGTT (SEQ ID NO: 922) | 2 |
| 350 | sHC | GAAGTATTTCATTTAAAAAAAAATCAAATCGATGTATTTTTTGACTTAATGATCAGTGTT (SEQ ID NO: 922) | 2 |
| 351 | sHC | AACTCTTCCATAAAGATTTATCAAAAATTCGAAAAGAAGAACAAGAAAAAGCCTAATTCC (SEQ ID NO: 908) | 3 |
| 352 | mHC | AACTCTTCCATAAAGATTTATCAAAAATTCGAAAAGAAGAACAAGAAAAAGCCTAATTCC (SEQ ID NO: 908) | 3 |
| 353 | mHC | TGTAATATAATTTTTTCTTTGAGATTTCTCGATAGCAAGTACTTATGCCTATTCCCAAGT (SEQ ID NO: 926) | 5 |
| 354 | sHC | TGTAATATAATTTTTTCTTTGAGATTTCTCGATAGCAAGTACTTATGCCTATTCCCAAGT (SEQ ID NO: 926) | 5 |
| 355 | mHC | GTGGAGTTTATCTTAACCACTTTTACAATCGAATAAGTACTTCATTTGCTGTATGCCCTT (SEQ ID NO: 928) | X |
| 356 | sHC | GTGGAGTTTATCTTAACCACTTTTACAATCGAATAAGTACTTCATTTGCTGTATGCCCTT (SEQ ID NO: 928) | X |
| 357 | mHC | AATAATTTCTCAATACTCTAGAAAGATATCGACTTAGGTAAAAAACTTGACAAGAGACAA (SEQ ID NO: 930) | 19 |
| 358 | sHC | AATAATTTCTCAATACTCTAGAAAGATATCGACTTAGGTAAAAAACTTGACAAGAGACAA (SEQ ID NO: 930) | 19 |
| 359 | mHC | GTGATGAAACTTAAAAAAAAATTTTTTTTCGAATTTTAAAAAATGGTTAATTGCTTCTAG (SEQ ID NO: 932) | 7 |
| 360 | sHC | GTGATGAAACTTAAAAAAAAATTTTTTTTCGAATTTTAAAAAATGGTTAATTGCTTCTAG (SEQ ID NO: 932) | 7 |

TABLE 1.e6

| | Probe Location | | | | | 4 kb Sequence Location | | | |
|---|---|---|---|---|---|---|---|---|---|
| | Start1 | End1 | Start2 | End2 | Chr | Start1 | End1 | Start2 | End2 |
| 287 | 70049970 | 70050001 | 70128487 | 70128518 | 6 | 70049970 | 70053971 | 70128487 | 70132488 |
| 288 | 70049970 | 70050001 | 70128487 | 70128518 | 6 | 70049970 | 70053971 | 70128487 | 70132488 |
| 289 | 175622206 | 175622237 | 175665390 | 175665421 | 4 | 175618236 | 175622237 | 175661420 | 175665421 |
| 290 | 175622206 | 175622237 | 175665390 | 175665421 | 4 | 175618236 | 175622237 | 175661420 | 175665421 |
| 291 | 157193122 | 157193153 | 157240029 | 157240060 | 6 | 157189152 | 157193153 | 157236059 | 157240060 |
| 292 | 157193122 | 157193153 | 157240029 | 157240060 | 6 | 157189152 | 157193153 | 157236059 | 157240060 |
| 293 | 151449133 | 151449164 | 151503790 | 151503821 | 6 | 151445163 | 151449164 | 151503790 | 151507791 |
| 294 | 151449133 | 151449164 | 151503790 | 151503821 | 6 | 151445163 | 151449164 | 151503790 | 151507791 |
| 295 | 110442182 | 110442213 | 110476775 | 110476806 | X | 110438212 | 110442213 | 110472805 | 110476806 |
| 296 | 110442182 | 110442213 | 110476775 | 110476806 | X | 110438212 | 110442213 | 110472805 | 110476806 |
| 297 | 75093036 | 75093067 | 75143109 | 75143140 | 12 | 75093036 | 75097037 | 75139139 | 75143140 |
| 298 | 75093036 | 75093067 | 75143109 | 75143140 | 12 | 75093036 | 75097037 | 75139139 | 75143140 |
| 299 | 20304911 | 20304942 | 20340862 | 20340893 | 2 | 20300941 | 20304942 | 20340862 | 20344863 |
| 300 | 20304911 | 20304942 | 20340862 | 20340893 | 2 | 20300941 | 20304942 | 20340862 | 20344863 |
| 301 | 107703592 | 107703623 | 107736901 | 107736932 | 3 | 107703592 | 107707593 | 107736901 | 107740902 |
| 302 | 107703592 | 107703623 | 107736901 | 107736932 | 3 | 107703592 | 107707593 | 107736901 | 107740902 |
| 303 | 37845589 | 37845620 | 37862801 | 37862832 | 4 | 37845589 | 37849590 | 37858831 | 37862832 |
| 304 | 37845589 | 37845620 | 37862801 | 37862832 | 4 | 37845589 | 37849590 | 37858831 | 37862832 |
| 305 | 37845589 | 37845620 | 37862832 | 37862863 | 4 | 37845589 | 37849590 | 37862832 | 37866833 |
| 306 | 37845589 | 37845620 | 37862832 | 37862863 | 4 | 37845589 | 37849590 | 37862832 | 37866833 |
| 307 | 22373651 | 22373682 | 22445850 | 22445881 | 8 | 22369681 | 22373682 | 22441880 | 22445881 |
| 308 | 22373651 | 22373682 | 22445850 | 22445881 | 8 | 22369681 | 22373682 | 22441880 | 22445881 |
| 309 | 38686830 | 38686861 | 38769693 | 38769724 | 9 | 38682860 | 38686861 | 38765723 | 38769724 |
| 310 | 38686830 | 38686861 | 38769693 | 38769724 | 9 | 38682860 | 38686861 | 38765723 | 38769724 |
| 311 | 130743981 | 130744012 | 130793708 | 130793739 | X | 130743981 | 130747982 | 130793708 | 130797709 |
| 312 | 130743981 | 130744012 | 130793708 | 130793739 | X | 130743981 | 130747982 | 130793708 | 130797709 |
| 313 | 195589030 | 195589061 | 195640867 | 195640898 | 2 | 195585060 | 195589061 | 195640867 | 195644868 |
| 314 | 195589030 | 195589061 | 195640867 | 195640898 | 2 | 195585060 | 195589061 | 195640867 | 195644868 |
| 315 | 129233271 | 129233302 | 129258579 | 129258610 | 2 | 129229301 | 129233302 | 129254609 | 129258610 |
| 316 | 129233271 | 129233302 | 129258579 | 129258610 | 2 | 129229301 | 129233302 | 129254609 | 129258610 |
| 317 | 28717278 | 28717309 | 28739610 | 28739641 | 7 | 28717278 | 28721279 | 28735640 | 28739641 |
| 318 | 28717278 | 28717309 | 28739610 | 28739641 | 7 | 28717278 | 28721279 | 28735640 | 28739641 |
| 319 | 58155952 | 58155983 | 58217905 | 58217936 | 18 | 58155952 | 58159953 | 58213935 | 58217936 |
| 320 | 58155952 | 58155983 | 58217905 | 58217936 | 18 | 58155952 | 58159953 | 58213935 | 58217936 |
| 321 | 82585655 | 82585686 | 82618801 | 82618832 | 4 | 82581685 | 82585686 | 82618801 | 82622802 |
| 322 | 82585655 | 82585686 | 82618801 | 82618832 | 4 | 82581685 | 82585686 | 82618801 | 82622802 |
| 323 | 151449133 | 151449164 | 151537463 | 151537494 | 6 | 151445163 | 151449164 | 151537463 | 151541464 |
| 324 | 151449133 | 151449164 | 151537463 | 151537494 | 6 | 151445163 | 151449164 | 151537463 | 151541464 |
| 325 | 131592737 | 131592768 | 131654358 | 131654389 | 9 | 131588767 | 131592768 | 131650388 | 131654389 |
| 326 | 131592737 | 131592768 | 131654358 | 131654389 | 9 | 131588767 | 131592768 | 131650388 | 131654389 |
| 327 | 28333746 | 28333777 | 28367003 | 28367034 | 9 | 28329776 | 28333777 | 28367003 | 28371004 |
| 328 | 28333746 | 28333777 | 28367003 | 28367034 | 9 | 28329776 | 28333777 | 28367003 | 28371004 |
| 329 | 209095320 | 209095351 | 209157796 | 209157827 | 2 | 209095320 | 209099321 | 209157796 | 209161797 |
| 330 | 209095320 | 209095351 | 209157796 | 209157827 | 2 | 209095320 | 209099321 | 209157796 | 209161797 |
| 331 | 78765449 | 78765480 | 78809049 | 78809080 | 2 | 78765449 | 78769450 | 78805079 | 78809080 |
| 332 | 78765449 | 78765480 | 78809049 | 78809080 | 2 | 78765449 | 78769450 | 78805079 | 78809080 |
| 333 | 107713586 | 107713617 | 107783201 | 107783232 | 3 | 107709616 | 107713617 | 107779231 | 107783232 |
| 334 | 107713586 | 107713617 | 107783201 | 107783232 | 3 | 107709616 | 107713617 | 107779231 | 107783232 |
| 335 | 24259095 | 24259126 | 24313984 | 24314015 | 3 | 24255125 | 24259126 | 24310014 | 24314015 |
| 336 | 24259095 | 24259126 | 24313984 | 24314015 | 3 | 24255125 | 24259126 | 24310014 | 24314015 |
| 337 | 169187906 | 169187937 | 169230654 | 169230685 | 6 | 169183936 | 169187937 | 169230654 | 169234655 |
| 338 | 169187906 | 169187937 | 169230654 | 169230685 | 6 | 169183936 | 169187937 | 169230654 | 169234655 |
| 339 | 65562483 | 65562514 | 65630949 | 65630980 | 8 | 65558513 | 65562514 | 65626979 | 65630980 |
| 340 | 65562483 | 65562514 | 65630949 | 65630980 | 8 | 65558513 | 65562514 | 65626979 | 65630980 |
| 341 | 89910342 | 89910373 | 89958362 | 89958393 | 8 | 89906372 | 89910373 | 89958362 | 89962363 |
| 342 | 89910342 | 89910373 | 89958362 | 89958393 | 8 | 89906372 | 89910373 | 89958362 | 89962363 |
| 343 | 38686830 | 38686861 | 38760727 | 38760758 | 9 | 38682860 | 38686861 | 38760727 | 38764728 |
| 344 | 38686830 | 38686861 | 38760727 | 38760758 | 9 | 38682860 | 38686861 | 38760727 | 38764728 |
| 345 | 70118659 | 70118690 | 70190375 | 70190406 | 6 | 70118659 | 70122660 | 70186405 | 70190406 |
| 346 | 70118659 | 70118690 | 70190375 | 70190406 | 6 | 70118659 | 70122660 | 70186405 | 70190406 |
| 347 | 31838005 | 31838036 | 31881452 | 31881483 | 10 | 31834035 | 31838036 | 31877482 | 31881483 |
| 348 | 31838005 | 31838036 | 31881452 | 31881483 | 10 | 31834035 | 31838036 | 31877482 | 31881483 |
| 349 | 72545342 | 72545373 | 72613114 | 72613145 | 2 | 72541372 | 72545373 | 72613114 | 72617115 |
| 350 | 72545342 | 72545373 | 72613114 | 72613145 | 2 | 72541372 | 72545373 | 72613114 | 72617115 |
| 351 | 24259095 | 24259126 | 24313984 | 24314015 | 3 | 24255125 | 24259126 | 24310014 | 24314015 |
| 352 | 24259095 | 24259126 | 24313984 | 24314015 | 3 | 24255125 | 24259126 | 24310014 | 24314015 |
| 353 | 24638174 | 24638205 | 24712809 | 24712840 | 5 | 24638174 | 24642175 | 24708839 | 24712840 |
| 354 | 24638174 | 24638205 | 24712809 | 24712840 | 5 | 24638174 | 24642175 | 24708839 | 24712840 |
| 355 | 46916544 | 46916575 | 46983732 | 46983763 | X | 46916544 | 46920545 | 46983732 | 46987733 |
| 356 | 46916544 | 46916575 | 46983732 | 46983763 | X | 46916544 | 46920545 | 46983732 | 46987733 |
| 357 | 44168555 | 44168586 | 44257710 | 44257741 | 19 | 44168555 | 44172556 | 44257710 | 44261711 |
| 358 | 44168555 | 44168586 | 44257710 | 44257741 | 19 | 44168555 | 44172556 | 44257710 | 44261711 |
| 359 | 7793942 | 7793973 | 7867790 | 7867821 | 7 | 7793942 | 7797943 | 7867790 | 7871791 |
| 360 | 7793942 | 7793973 | 7867790 | 7867821 | 7 | 7793942 | 7797943 | 7867790 | 7871791 |

TABLE 1.e7

| | Probe | PCR-Primer1_ID | PCR_Primer1 |
|---|---|---|---|
| 287 | ORF176_6_70049970_70053583_70128487_70130693_RR | OBD159_561 | TGGTTAGGTTCAAACTCAGGTAGCCT (SEQ ID NO: 934) |
| 288 | ORF176_6_70049970_70053583_70128487_70130693_RR | OBD159_561 | TGGTTAGGTTCAAACTCAGGTAGCCT (SEQ ID NO: 934) |
| 289 | ORF177_4_175618295_175622237_175657671_175665421_FB | OBD159_565 | AAGGCAGAGGATAAGATAGTGGTCTC (SEQ ID NO: 936) |
| 290 | ORF177_4_175618295_175622237_175657671_175665421_FB | OBD159_565 | AAGGCAGAGGATAAGATAGTGGTCTC (SEQ ID NO: 936) |
| 291 | ORF178_6_157189218_157193153_157237058_157240060_FB | OBD159_569 | GCCTTCCCTGCCTTCTTACTTCC (SEQ ID NO: 938) |
| 292 | ORF178_6_157189218_157193153_157237058_157240060_FB | OBD159_569 | GCCTTCCCTGCCTTCTTACTTCC (SEQ ID NO: 938) |
| 293 | ORF179_6_151443530_151449164_151503790_151504867_FR | OBD159_573 | CGCCTGTAACCCCAGCATTTTGG (SEQ ID NO: 940) |
| 294 | ORF179_6_151443530_151449164_151503790_151504867_FR | OBD159_573 | CGCCTGTAACCCCAGCATTTTGG (SEQ ID NO: 940) |
| 295 | ORF179_X_110436218_110442213_110470734_110476806_FB | OBD159_577 | ACAGGGACTGAGCAGGTCGCTGAAAA (SEQ ID NO: 942) |
| 296 | ORF179_X_110436218_110442213_110470734_110476806_FB | OBD159_577 | ACAGGGACTGAGCAGGTCGCTGAAAA (SEQ ID NO: 942) |
| 297 | ORF18_12_75093036_75104058_75141366_75143140_RF | OBD159_581 | ATCCTCAGAATGGGTCCGTCTCAGAG (SEQ ID NO: 944) |
| 298 | ORF18_12_75093036_75104058_75141366_75143140_RF | OBD159_581 | ATCCTCAGAATGGGTCCGTCTCAGAG (SEQ ID NO: 944) |
| 299 | ORF18_2_20303337_20304942_20340862_20341927_FR | OBD159_585 | CAGCACAGTGGAGTGGTCGTGAC (SEQ ID NO: 946) |
| 300 | ORF18_2_20303337_20304942_20340862_20341927_FR | OBD159_585 | CAGCACAGTGGAGTGGTCGTGAC (SEQ ID NO: 946) |
| 301 | ORF18_3_107703592_107708851_107736901_107739665_RR | OBD159_589 | GATAAAAGCCCTACAAGTGCTAATCA (SEQ ID NO: 948) |
| 302 | ORF18_3_107703592_107708851_107736901_107739665_RR | OBD159_589 | GATAAAAGCCCTACAAGTGCTAATCA (SEQ ID NO: 948) |
| 303 | ORF18_4_37845589_37847420_37859966_37862832_RF | OBD159_593 | CTTACAGCCTTCCAAAATAACTCCAG (SEQ ID NO: 950) |
| 304 | ORF18_4_37845589_37847420_37859966_37862832_RF | OBD159_593 | CTTACAGCCTTCCAAAATAACTCCAG (SEQ ID NO: 950) |
| 305 | ORF18_4_37845589_37847420_37862832_37864637_RR | OBD159_597 | TGCCACAGCAAGTCTATCAGCATCCG (SEQ ID NO: 952) |
| 306 | ORF18_4_37845589_37847420_37862832_37864637_RR | OBD159_597 | TGCCACAGCAAGTCTATCAGCATCCG (SEQ ID NO: 952) |
| 307 | ORF18_8_22370928_22373682_22443319_22445881_FF | OBD159_601 | CTTTTACTTCAGGGACCCCAGGTGTC (SEQ ID NO: 954) |
| 308 | ORF18_8_22370928_22373682_22443319_22445881_FF | OBD159_601 | CTTTTACTTCAGGGACCCCAGGTGTC (SEQ ID NO: 954) |
| 309 | ORF18_9_38681931_38686861_38768696_38769724_FF | OBD159_605 | GCCAGAAGTTCACAGGCAGGGTG (SEQ ID NO: 72) |
| 310 | ORF18_9_38681931_38686861_38768696_38769724_FF | OBD159_605 | GCCAGAAGTTCACAGGCAGGGTG (SEQ ID NO: 72) |
| 311 | ORF18_X_130743981_130757818_130793708_130805512_RR | OBD159_609 | CTACCACCACCAGCATCCCAATACAC (SEQ ID NO: 958) |
| 312 | ORF18_X_130743981_130757818_130793708_130805512_RR | OBD159_609 | CTACCACCACCAGCATCCCAATACAC (SEQ ID NO: 958) |

TABLE 1.e7-continued

| Probe | PCR-Primer1_ID | PCR_Primer1 |
|---|---|---|
| 313 ORF180_2_195583610_195589061_195640867_195645128_FR | OBD159_613 | CAGGCTATTGGAATGGCTGAAGTGTG (SEQ ID NO: 514) |
| 314 ORF180_2_195583610_195589061_195640867_195645128_FR | OBD159_613 | CAGGCTATTGGAATGGCTGAAGTGTG (SEQ ID NO: 514) |
| 315 ORF181_2_129231919_129233302_129249318_129258610_FF | OBD159_617 | TACCACTTGAAGGGAGGGTTGCTTTT (SEQ ID NO: 962) |
| 316 ORF181_2_129231919_129233302_129249318_129258610_FF | OBD159_617 | TACCACTTGAAGGGAGGGTTGCTTTT (SEQ ID NO: 962) |
| 317 ORF182_7_28717278_28719857_28738396_28739641_RF | OBD159_621 | TTGGAGGGAGAATACAAAGAGTGAGC (SEQ ID NO: 964) |
| 318 ORF182_7_28717278_28719857_28738396_28739641_RF | OBD159_621 | TTGGAGGGAGAATACAAAGAGTGAGC (SEQ ID NO: 964) |
| 319 ORF185_18_58155952_58157838_58215328_58217936_RF | OBD159_625 | TGTAGAGCCAAATAGCCACAGGGATA (SEQ ID NO: 966) |
| 320 ORF185_18_58155952_58157838_58215328_58217936_RF | OBD159_625 | TGTAGAGCCAAATAGCCACAGGGATA (SEQ ID NO: 966) |
| 321 ORF185_4_82581680_82585686_82618801_82621987_FR | OBD159_629 | CTGGACCTTTCCTTGGCTGCCCT (SEQ ID NO: 968) |
| 322 ORF185_4_82581680_82585686_82618801_82621987_FR | OBD159_629 | CTGGACCTTTCCTTGGCTGCCCT (SEQ ID NO: 968) |
| 323 ORF185_6_151443530_151449164_151537463_151538576_FR | OBD159_633 | CGCCTGTAACCCCAGCATTTTGG (SEQ ID NO: 940) |
| 324 ORF185_6_151443530_151449164_151537463_151538576_FR | OBD159_633 | CGCCTGTAACCCCAGCATTTTGG (SEQ ID NO: 940) |
| 325 ORF185_9_131590628_131592768_131652374_131654389_FF | OBD159_637 | CTGTTCAAACCCGTCAGCAGGAT (SEQ ID NO: 972) |
| 326 ORF185_9_131590628_131592768_131652374_131654389_FF | OBD159_637 | CTGTTCAAACCCGTCAGCAGGAT (SEQ ID NO: 972) |
| 327 ORF187_9_28314155_28333777_28367003_28368817_FR | OBD159_641 | AAACCAGTCAATCCTCAAGTGTGC (SEQ ID NO: 974) |
| 328 ORF187_9_28314155_28333777_28367003_28368817_FR | OBD159_641 | AAACCAGTCAATCCTCAAGTGTGC (SEQ ID NO: 974) |
| 329 ORF188_2_209095320_209098567_209157796_209164211_RR | OBD159_645 | CGTGTCTTTTCTCTGGGACCTGTGAT (SEQ ID NO: 976) |
| 330 ORF188_2_209095320_209098567_209157796_209164211_RR | OBD159_645 | CGTGTCTTTTCTCTGGGACCTGTGAT (SEQ ID NO: 976) |
| 331 ORF19_2_78765449_78768597_78804372_78809080_RF | OBD159_649 | GGAAAAGAGATAAACACACAAATA (SEQ ID NO: 978) |
| 332 ORF19_2_78765449_78768597_78804372_78809080_RF | OBD159_649 | GGAAAAGAGATAAACACACAAATA (SEQ ID NO: 978) |
| 333 ORF19_3_107708851_107713617_107779656_107783232_FF | OBD159_653 | CAATCTAATGATGTCCCTCCACTGCT (SEQ ID NO: 980) |
| 334 ORF19_3_107708851_107713617_107779656_107783232_FF | OBD159_653 | CAATCTAATGATGTCCCTCCACTGCT (SEQ ID NO: 980) |
| 335 ORF19_3_24254159_24259126_24306563_24314015_FF | OBD159_657 | GCCTCCTGATGCTTCCTTCGTGCCCC (SEQ ID NO: 982) |
| 336 ORF19_3_24254159_24259126_24306563_24314015_FF | OBD159_657 | GCCTCCTGATGCTTCCTTCGTGCCCC (SEQ ID NO: 982) |
| 337 ORF19_6_169185535_169187937_169230654_169232256_FR | OBD159_661 | ACACATCCACTGATAGGCAACAACTG (SEQ ID NO: 984) |
| 338 ORF19_6_169185535_169187937_169230654_169232256_FR | OBD159_661 | ACACATCCACTGATAGGCAACAACTG |

TABLE 1.e7-continued

| Probe | PCR-Primer1_ID | PCR_Primer1 |
|---|---|---|
| | | (SEQ ID NO: 984) |
| 339 ORF19_8_65560550_65562514_65628655_65630980_FF | OBD159_665 | CATTTCTCTGCTGCCATCTCGTGGAT (SEQ ID NO: 772) |
| 340 ORF19_8_65560550_65562514_65628655_65630980_FF | OBD159_665 | CATTTCTCTGCTGCCATCTCGTGGAT (SEQ ID NO: 772) |
| 341 ORF19_8_89905359_89910373_89958362_89963906_FR | OBD159_669 | ATCACCTCAGCAGATAGGCATTTA (SEQ ID NO: 988) |
| 342 ORF19_8_89905359_89910373_89958362_89963906_FR | OBD159_669 | ATCACCTCAGCAGATAGGCATTTA (SEQ ID NO: 988) |
| 343 ORF19_9_38681931_38686861_38760727_38762491_FR | OBD159_673 | GCCAGAAGTTCACAGGCAGGGTG (SEQ ID NO: 72) |
| 344 ORF19_9_38681931_38686861_38760727_38762491_FR | OBD159_673 | GCCAGAAGTTCACAGGCAGGGTG (SEQ ID NO: 72) |
| 345 ORF190_6_70118659_70128487_70187099_70190406_RF | OBD159_677 | GAAGTTTCAAATAGGCAAGCCAACCC (SEQ ID NO: 992) |
| 346 ORF190_6_70118659_70128487_70187099_70190406_RF | OBD159_677 | GAAGTTTCAAATAGGCAAGCCAACCC (SEQ ID NO: 992) |
| 347 ORF191_10_31830982_31838036_31880198_31881483_FF | OBD159_681 | TATGGCACTGTGGGAGGTAATGGG (SEQ ID NO: 994) |
| 348 ORF191_10_31830982_31838036_31880198_31881483_FF | OBD159_681 | TATGGCACTGTGGGAGGTAATGGG (SEQ ID NO: 994) |
| 349 ORF191_2_72535662_72545373_72613114_72619302_FR | OBD159_685 | GTTTATTACCTTTCACTGCCAGAT (SEQ ID NO: 996) |
| 350 ORF191_2_72535662_72545373_72613114_72619302_FR | OBD159_685 | GTTTATTACCTTTCACTGCCAGAT (SEQ ID NO: 996) |
| 351 ORF194_3_24254159_24259126_24306563_24314015_FF | OBD159_657 | GCCTCCTGATGCTTCCTTCGTGCCCC (SEQ ID NO: 982) |
| 352 ORF194_3_24254159_24259126_24306563_24314015_FF | OBD159_657 | GCCTCCTGATGCTTCCTTCGTGCCCC (SEQ ID NO: 982) |
| 353 ORF194_5_24638174_24644400_24709728_24712840_RF | OBD159_689 | GATTGAGGGAAGAATACAAGAACTA (SEQ ID NO: 1000) |
| 354 ORF194_5_24638174_24644400_24709728_24712840_RF | OBD159_689 | GATTGAGGGAAGAATACAAGAACTA (SEQ ID NO: 1000) |
| 355 ORF194_X_46916544_46918054_46983732_46995250_RR | OBD159_693 | AGCACTCTTCCTCCTGACTGTGAGAA (SEQ ID NO: 1002) |
| 356 ORF194_X_46916544_46918054_46983732_46995250_RR | OBD159_693 | AGCACTCTTCCTCCTGACTGTGAGAA (SEQ ID NO: 1002) |
| 357 ORF197_19_44168555_44170532_44257710_44261871_RR | OBD159_697 | CCTCCCTACTTTTATGGCATCTCTGC (SEQ ID NO: 1004) |
| 358 ORF197_19_44168555_44170532_44257710_44261871_RR | OBD159_697 | CCTCCCTACTITTATGGCATCTCTGC (SEQ ID NO: 1004) |
| 359 ORF198_7_7793942_7796470_7867790_7872166_RR | OBD159_701 | GCAAGTTCTCTTCCAGTTGATTTCCT (SEQ ID NO: 1006) |
| 360 ORF198_7_7793942_7796470_7867790_7872166_RR | OBD159_701 | GCAAGTTCTCTTCCAGTTGATTTCCT (SEQ ID NO: 1006) |

TABLE 1.e8

| | PCR-Primer2_ID | PCR_Primer2 | Marker | GLMNET |
|---|---|---|---|---|
| 287 | OBD159_563 | TAAGTCTACCTTCTCTCTCCTATTGC (SEQ ID NO: 1008) | OBD159_561_563 | -0.003563183 |

TABLE 1.e8-continued

| | PCR-Primer2_ID | PCR_Primer2 | Marker | GLMNET |
|---|---|---|---|---|
| 288 | OBD159_563 | TAAGTCTACCTTCTCTCTCCTATTGC (SEQ ID NO: 1008) | OBD159_561_563 | -0.003563183 |
| 289 | OBD159_567 | CCCGAGGGATAGGGATTCTGTTTTGT (SEQ ID NO: 1010) | OBD159_565_567 | -0.004067662 |
| 290 | OBD159_567 | CCCGAGGGATAGGGATTCTGTTTTGT (SEQ ID NO: 1010) | OBD159_565_567 | -0.004067662 |
| 291 | OBD159_571 | AATCTCCTCTGGTCGCTCCCACC (SEQ ID NO: 1012) | OBD159_569_571 | -0.002042219 |
| 292 | OBD159_571 | AATCTCCTCTGGTCGCTCCCACC (SEQ ID NO: 1012) | OBD159_569_571 | -0.002042219 |
| 293 | OBD159_575 | ATTGCCAAAAGTGCCCCAAATGATTA (SEQ ID NO: 1014) | OBD159_573_575 | -0.002608653 |
| 294 | OBD159_575 | ATTGCCAAAAGTGCCCCAAATGATTA (SEQ ID NO: 1014) | OBD159_573_575 | -0.002608653 |
| 295 | OBD159_579 | ACACAACTGACAAATCCTTAGGTGGA (SEQ ID NO: 1016) | OBD159_577_579 | -0.003390089 |
| 296 | OBD159_579 | ACACAACTGACAAATCCTTAGGTGGA (SEQ ID NO: 1016) | OBD159_577_579 | -0.003390089 |
| 297 | OBD159_583 | TTTCCACTCTCCACCCTCATTTCCTT (SEQ ID NO: 1018) | OBD159_581_583 | -0.005421425 |
| 298 | OBD159_583 | TTTCCACTCTCCACCCTCATTTCCTT (SEQ ID NO: 1018) | OBD159_581_583 | -0.005421425 |
| 299 | OBD159_587 | CTATGAGGGAGGCATTGTTGTTTC (SEQ ID NO: 1020) | OBD159_585_587 | -0.002765198 |
| 300 | OBD159_587 | CTATGAGGGAGGCATTGTTGTTTC (SEQ ID NO: 1020) | OBD159_585_587 | -0.002765198 |
| 301 | OBD159_591 | GCTGGCTCCAACAAAACAGGCATTCT (SEQ ID NO: 1022) | OBD159_589_591 | -0.003382607 |
| 302 | OBD159_591 | GCTGGCTCCAACAAAACAGGCATTCT (SEQ ID NO: 1022) | OBD159_589_591 | -0.003382607 |
| 303 | OBD159_595 | TGCCACAGCAAGTCTATCAGCATCCG (SEQ ID NO: 952) | OBD159_593_595 | -0.001541024 |
| 304 | OBD159_595 | TGCCACAGCAAGTCTATCAGCATCCG (SEQ ID NO: 952) | OBD159_593_595 | -0.001541024 |
| 305 | OBD159_599 | GTTCCATCATAGCAGGATTGGGTCAT (SEQ ID NO: 1026) | OBD159_597_599 | -0.003762922 |
| 306 | OBD159_599 | GTTCCATCATAGCAGGATTGGGTCAT (SEQ ID NO: 1026) | OBD159_597_599 | -0.003762922 |
| 307 | OBD159_603 | CACTTGATACAATACCAACCCAGAAG (SEQ ID NO: 1028) | OBD159_601_603 | -0.002467858 |
| 308 | OBD159_603 | CACTTGATACAATACCAACCCAGAAG (SEQ ID NO: 1028) | OBD159_601_603 | -0.002467858 |
| 309 | OBD159_607 | TCTTCCAACATCACTCCCAGGGC (SEQ ID NO: 1030) | OBD159_605_607 | -0.002130396 |
| 310 | OBD159_607 | TCTTCCAACATCACTCCCAGGGC (SEQ ID NO: 1030) | OBD159_605_607 | -0.002130396 |
| 311 | OBD159_611 | TTCTGCTCACGGAACACAAACACCTT (SEQ ID NO: 1032) | OBD159_609_611 | -0.001186762 |
| 312 | OBD159_611 | TTCTGCTCACGGAACACAAACACCTT (SEQ ID NO: 1032) | OBD159_609_611 | -0.001186762 |
| 313 | OBD159_615 | GCTGATAATAGTGTGTGTGGGAGGAG (SEQ ID NO: 1034) | OBD159_613_615 | -0.002324947 |

TABLE 1.e8-continued

| | PCR-Primer2_ID | PCR_Primer2 | Marker | GLMNET |
|---|---|---|---|---|
| 314 | OBD159_615 | GCTGATAATAGTGTGTGTGGGAGGAG (SEQ ID NO: 1034) | OBD159_613_615 | -0.002324947 |
| 315 | OBD159_619 | CAGTGTCTGGATTGAAGTGTAAAGGC (SEQ ID NO: 1036) | OBD159_617_619 | -0.001555863 |
| 316 | OBD159_619 | CAGTGTCTGGATTGAAGTGTAAAGGC (SEQ ID NO: 1036) | OBD159_617_619 | -0.001555863 |
| 317 | OBD159_623 | GCTAACCACCAGAGTCACACACATCA (SEQ ID NO: 1038) | OBD159_621_623 | -0.003169593 |
| 318 | OBD159_623 | GCTAACCACCAGAGTCACACACATCA (SEQ ID NO: 1038) | OBD159_621_623 | -0.003169593 |
| 319 | OBD159_627 | TCTGGTTCAAGGAGTGGCTAAGGACC (SEQ ID NO: 1040) | OBD159_625_627 | -0.003491777 |
| 320 | OBD159_627 | TCTGGTTCAAGGAGTGGCTAAGGACC (SEQ ID NO: 1040) | OBD159_625_627 | -0.003491777 |
| 321 | OBD159_631 | GCATCCCAGCATCTACTTCCCAG (SEQ ID NO: 1042) | OBD159_629_631 | -0.000778334 |
| 322 | OBD159_631 | GCATCCCAGCATCTACTTCCCAG (SEQ ID NO: 1042) | OBD159_629_631 | -0.000778334 |
| 323 | OBD159_635 | CCTGGATTCTAACTGTGAGTGATAAA (SEQ ID NO: 1044) | OBD159_633_635 | -0.003132189 |
| 324 | OBD159_635 | CCTGGATTCTAACTGTGAGTGATAAA (SEQ ID NO: 1044) | OBD159_633_635 | -0.003132189 |
| 325 | OBD159_639 | ATCTCAGCATTATTACAACCAGTTCC (SEQ ID NO: 1046) | OBD159_637_639 | -0.000924073 |
| 326 | OBD159_639 | ATCTCAGCATTATTACAACCAGTTCC (SEQ ID NO: 1046) | OBD159_637_639 | -0.000924073 |
| 327 | OBD159_643 | CCAGAAAGAATGATGAATGTGTTC (SEQ ID NO: 284) | OBD159_641_643 | -0.002329432 |
| 328 | OBD159_643 | CCAGAAAGAATGATGAATGTGTTC (SEQ ID NO: 284) | OBD159_641_643 | -0.002329432 |
| 329 | OBD159_647 | GAGAACATTCCTTTTCCTCTGTAGAA (SEQ ID NO: 1050) | OBD159_645_647 | -0.001749435 |
| 330 | OBD159_647 | GAGAACATTCCTTTTCCTCTGTAGAA (SEQ ID NO: 1050) | OBD159_645_647 | -0.001749435 |
| 331 | OBD159_651 | GAAAATAGAGGAATGAGATTAGATT (SEQ ID NO: 1052) | OBD159_649_651 | -0.002089096 |
| 332 | OBD159_651 | GAAAATAGAGGAATGAGATTAGATT (SEQ ID NO: 1052) | OBD159_649_651 | -0.002089096 |
| 333 | OBD159_655 | CTCTAAAATGGCTGCTTCTCAGTGAC (SEQ ID NO: 1054) | OBD159_653_655 | -0.000249952 |
| 334 | OBD159_655 | CTCTAAAATGGCTGCTTCTCAGTGAC (SEQ ID NO: 1054) | OBD159_653_655 | -0.000249952 |
| 335 | OBD159_659 | CATTTCCTTTTCTACACTGTTCATTCAC (SEQ ID NO: 1056) | OBD159_657_659 | -0.004064705 |
| 336 | OBD159_659 | CATTTCCTTTTCTACACTGTTCATTCAC (SEQ ID NO: 1056) | OBD159_657_659 | -0.004064705 |
| 337 | OBD159_663 | TATGTTACACCCCTTGGCTACCCAGC (SEQ ID NO: 1058) | OBD159_661_663 | -0.002744953 |
| 338 | OBD159_663 | TATGTTACACCCCTTGGCTACCCAGC (SEQ ID NO: 1058) | OBD159_661_663 | -0.002744953 |
| 339 | OBD159_667 | GCAGTTGGTGCTCTGTATCCACA (SEQ ID NO: 1060) | OBD159_665_667 | -0.002635718 |

TABLE 1.e8-continued

| | PCR-Primer2_ID | PCR_Primer2 | Marker | GLMNET |
|---|---|---|---|---|
| 340 | OBD159_667 | GCAGTTGGTGCTCTGTATCCACA (SEQ ID NO: 1060) | OBD159_665_667 | -0.002635718 |
| 341 | OBD159_671 | TTTTCGGCTTTGAAGACTGTTGAT (SEQ ID NO: 1062) | OBD159_669_671 | -0.002126128 |
| 342 | OBD159_671 | TTTTCGGCTTTGAAGACTGTTGAT (SEQ ID NO: 1062) | OBD159_669_671 | -0.002126128 |
| 343 | OBD159_675 | GCAAGCATCGGAAGCAGACTCAG (SEQ ID NO: 1064) | OBD159_673_675 | -0.00192616 |
| 344 | OBD159_675 | GCAAGCATCGGAAGCAGACTCAG (SEQ ID NO: 1064) | OBD159_673_675 | -0.00192616 |
| 345 | OBD159_679 | CAATGCCAAGAGCAATGAGGCTACAG (SEQ ID NO: 1066) | OBD159_677_679 | -0.002385475 |
| 346 | OBD159_679 | CAATGCCAAGAGCAATGAGGCTACAG (SEQ ID NO: 1066) | OBD159_677_679 | -0.002385475 |
| 347 | OBD159_683 | GCCAACACGGAACACACACAAAA (SEQ ID NO: 1068) | OBD159_681_683 | -0.002702656 |
| 348 | OBD159_683 | GCCAACACGGAACACACACAAAA (SEQ ID NO: 1068) | OBD159_681_683 | -0.002702656 |
| 349 | OBD159_687 | ATGAACTCCACCCAGCAAATGCCT (SEQ ID NO: 1070) | OBD159_685_687 | -0.003035174 |
| 350 | OBD159_687 | ATGAACTCCACCCAGCAAATGCCT (SEQ ID NO: 1070) | OBD159_685_687 | -0.003035174 |
| 351 | OBD159_659 | CATTTCCTTTTCTACACTGTTCATTCAC (SEQ ID NO: 1056) | OBD159_669_671 | -0.000889529 |
| 352 | OBD159_659 | CATTTCCTTTTCTACACTGTTCATTCAC (SEQ ID NO: 1056) | OBD159_669_671 | -0.000889529 |
| 353 | OBD159_691 | GTGAAGAGTGGAGGTTTTCTACAGA (SEQ ID NO: 1074) | OBD159_689_691 | -0.002347474 |
| 354 | OBD159_691 | GTGAAGAGTGGAGGTTTTCTACAGA (SEQ ID NO: 1074) | OBD159_689_691 | -0.002347474 |
| 355 | OBD159_695 | ATGGACGACCCTCTTCCCAGCAAAT (SEQ ID NO: 1076) | OBD159_693_695 | -0.002919455 |
| 356 | OBD159_695 | ATGGACGACCCTCTTCCCAGCAAAT (SEQ ID NO: 1076) | OBD159_693_695 | -0.002919455 |
| 357 | OBD159_699 | TTATGTCTCCCTTCAGTTCCATCAAT (SEQ ID NO: 1078) | OBD159_697_699 | -0.001832913 |
| 358 | OBD159_699 | TTATGTCTCCCTTCAGTTCCATCAAT (SEQ ID NO: 1078) | OBD159_697_699 | -0.001832913 |
| 359 | OBD159_703 | TTTGTATCCAACCCCTTCCCCAGAGC (SEQ ID NO: 1080) | OBD159_701_703 | -0.002112997 |
| 360 | OBD159_703 | TTTGTATCCAACCCCTTCCCCAGAGC (SEQ ID NO: 1080) | OBD159_701_703 | -0.002112997 |

55

TABLE 1.e9

| | Gene |
|---|---|
| 287 | COL19A1; rs771562232 |
| 288 | COL19A1; rs771562232 |
| 289 | GPM6A; rs13144140 |
| 290 | GPM6A; rs13144140 |
| 291 | ARID1B; rs1057518918; rs1057518691; rs773740590; rs886044620; rs797044859; rs879253746; rs797045278; rs1057518984; rs797045279; rs797045280; rs797045281; rs797045282; rs886041706; rs797045283; rs9406316 |

TABLE 1.e9-continued

| | Gene |
|---|---|
| 292 | ARID1B; rs1057518918; rs1057518691; rs773740590; rs886044620; rs797044859; rs879253746; rs797045278; rs1057518984; rs797045279; rs797045280; rs797045281; rs797045282; rs886041706; rs797045283; rs9406316 |
| 293 | C6orf211; CCDC170; RMND1; rs370863743; rs6933660; rs1971256 |
| 294 | C6orf211; CCDC170; RMND1; rs370863743; rs6933660; rs1971256 |

TABLE 1.e9-continued

| | Gene |
|---|---|
| 295 | AMMECR1; RGAG1; rs1573036 |
| 296 | AMMECR1; RGAG1; rs1573036 |
| 297 | CAPS2; KCNC2 |
| 298 | CAPS2; KCNC2 |
| 299 | PUM2; rs111612372 |
| 300 | PUM2; rs111612372 |
| 301 | BBX; rs11710737 |
| 302 | BBX; rs11710737 |
| 303 | GAFA3; PGM2 |
| 304 | GAFA3; PGM2 |
| 305 | GAFA3; PGM2 |
| 306 | GAFA3; PGM2 |
| 307 | PIWIL2; PPP3CC; SLC39A14; rs879253763; rs879253764; rs879253765; rs1039778197; rs879253766; rs750281602; rs7833266; rs2272080 |
| 308 | PIWIL2; PPP3CC; SLC39A14; rs879253763; rs879253764; rs879253765; rs1039778197; rs879253766; rs750281602; rs7833266; rs2272080 |
| 309 | ANKRD18A; CNTNAP3 |
| 310 | ANKRD18A; CNTNAP3 |
| 311 | ARHGAP36; ENOX2 |
| 312 | ARHGAP36; ENOX2 |
| 313 | DNAH7; SLC39A10 |
| 314 | DNAH7; SLC39A10 |
| 315 | rs7567687; rs1660895 |
| 316 | rs7567687; rs1660895 |
| 317 | CREB5; rs56388170 |
| 318 | CREB5; rs56388170 |
| 319 | NEDD4L; rs4149601 |
| 320 | NEDD4L; rs4149601 |
| 321 | rs13138355; rs72909131 |
| 322 | rs13138355; rs72909131 |
| 323 | C6orf211; CCDC170; RMND1; rs370863743; rs6933660; rs1971256; rs9479055; rs6931664 |
| 324 | C6orf211; CCDC170; RMND1; rs370863743; rs6933660; rs1971256; rs9479055; rs6931664 |
| 325 | RAPGEF1; rs4740283; rs11243444 |
| 326 | RAPGEF1; rs4740283; rs11243444 |
| 327 | LINGO2; rs10812774 |
| 328 | LINGO2; rs10812774 |
| 329 | MAP2; PTH2R |
| 330 | MAP2; PTH2R |
| 331 | REG3G |
| 332 | REG3G |
| 333 | BBX; rs670752; rs11710737; rs6437740 |
| 334 | BBX; rs670752; rs11710737; rs6437740 |
| 335 | THRB; rs1505297; rs826230; rs826231; rs862247; rs826236; rs826238; rs826240; rs1868575; rs113700287; rs1158265; rs9830674; rs2167115; rs1505307; rs1505283; rs12485694; rs869785; rs869784; rs9310736; rs7622481 |
| 336 | THRB; rs1505297; rs826230; rs826231; rs862247; rs826236; rs826238; rs826240; rs1868575; rs113700287; rs1158265; rs9830674; rs2167115; rs1505307; rs1505283; rs12485694; rs869785; rs869784; rs9310736; rs7622481 |
| 337 | THBS2; rs9406328 |
| 338 | THBS2; rs9406328 |
| 339 | ARMC1; rs6991838 |
| 340 | ARMC1; rs6991838 |
| 341 | NBN; OSGIN2; rs121908973; rs10464867; rs14448; rs13312986; rs1063054; rs2735383; rs142301194; rs1057517262; rs756363734; rs786204181; rs1064795816; rs730881864; rs730881857; rs786201965; rs775397477; rs1057517075; rs786203223; rs786203920; rs1057516869; rs1061302; rs1057516852; rs587782653; rs1057516668; rs587782545; rs1060503466; rs1377580273; rs1057516611; rs61753717; rs864622143; rs786201745; rs749918573; rs766044684; rs1060503481; rs776417262; rs1057516332; rs1060503480; rs587782344; rs759232053; rs786203180; rs587782130; rs864622333; rs876659666; rs730881850; rs1060503467; rs709816; rs746965070; rs587781969; rs1057519588; rs1057517102; rs1057517209; rs121908974; rs876660290; rs767215758; rs876659521 |
| 342 | NBN; OSGIN2; rs121908973; rs10464867; rs14448; rs13312986; rs1063054; rs2735383; rs142301194; rs1057517262; rs756363734; rs786204181; rs1064795816; rs730881864; rs730881857; rs786201965; rs775397477; rs1057517075; rs786203223; rs786203920; rs1057516869; rs1061302; rs1057516852; rs587782653; rs1057516668; rs587782545; |

TABLE 1.e9-continued

| | Gene |
|---|---|
| | rs1060503466; rs1377580273; rs1057516611; rs61753717; rs864622143; rs786201745; rs749918573; rs766044684; rs1060503481; rs776417262; rs1057516332; rs1060503480; rs587782344; rs759232053; rs786203180; rs587782130; rs864622333; rs876659666; rs730881850; rs1060503467; rs709816; rs746965070; rs587781969; rs1057519588; rs1057517102; rs1057517209; rs121908974; rs876660290; rs767215758; rs876659521 |
| 343 | ANKRD18A; CNTNAP3 |
| 344 | ANKRD18A; CNTNAP3 |
| 345 | COL19A1; rs658805; rs771562232 |
| 346 | COL19A1; rs658805; rs771562232 |
| 347 | ARHGAP12; rs211257 |
| 348 | ARHGAP12; rs211257 |
| 349 | EXOC6B; rs2421095 |
| 350 | EXOC6B; rs2421095 |
| 351 | THRB; rs1505297; rs826230; rs826231; rs862247; rs826236; rs826238; rs826240; rs1868575; rs113700287; rs1158265; rs9830674; rs2167115; rs1505307; rs1505283; rs12485694; rs869785; rs869784; rs9310736; rs7622481 |
| 352 | THRB; rs1505297; rs826230; rs826231; rs862247; rs826236; rs826238; rs826240; rs1868575; rs113700287; rs1158265; rs9830674; rs2167115; rs1505307; rs1505283; rs12485694; rs869785; rs869784; rs9310736; rs7622481 |
| 353 | CDH10 |
| 354 | CDH10 |
| 355 | JADE3; RP2 |
| 356 | JADE3; RP2 |
| 357 | ZNF226; ZNF227; ZNF233; ZNF234; ZNF235 |
| 358 | ZNF226; ZNF227; ZNF233; ZNF234; ZNF235 |
| 359 | rs17137412; rs37972 |
| 360 | rs17137412; rs37972 |

TABLE 2.a1

| | Probe | GeneLocus |
|---|---|---|
| 1 | ORF1_16_68414192_68421728_ 68462182_68469147_RF | SMPD3; rs2863973 |
| 2 | ORF1_7_107580951_107585747_ 107694264_107700145_RF | BCAP29; SLC26A4 |
| 3 | ORF1_8_28471461_28475878_ 28536205_28541536_FR | FBXO16; FZD3 |
| 4 | ORF10_1_177039010_177043486_ 177103748_177111201_RF | ASTN1 |
| 5 | ORF10_1_186754095_186757863_ 186806428_186824334_FR | PLA2G4A; rs4140564 |
| 6 | ORF10_16_5855640_5863059_ 5995131_5999657_RR | NA |
| 7 | ORF10_5_160420118_160421640_ 160489817_160495294_FF | PTTG1; SLU7 |
| 8 | ORF10_6_154294994_154298490_ 154323035_154324807_FR | CNKSR3; IPCEF1; OPRM1 |
| 9 | ORF10_7_106998395_107001277_ 107064399_107071524_RR | PRKAR2B |
| 10 | ORF100_1_77409324_77410804_ 77438815_77446913_FR | AK5; rs6695572 |
| 11 | ORF101_2_20454246_20457908_ 20490253_20493006_RR | RHOB |
| 12 | ORF101_4_152168385_152172738_ 152191742_152196830_FR | FBXW7 |
| 13 | ORF102_11_9783875_9784929_ 9820736_9821985_FF | SBF2 |
| 14 | ORF102_21_27949757_27955906_ 28009218_28020470_RR | NA |
| 15 | ORF103_18_58202022_58205094_ 58215328_58217936_RF | NEDD4L; rs17064520 |
| 16 | ORF106_X_39224581_39226649_ 39303922_39309694_RF | NA |
| 17 | ORF107_7_38594689_38595956_ 38633652_38638705_RR | AMPH; FAM183B |
| 18 | ORF108_11_33554299_33557937_ 33584612_33595244_RF | KIAA1549L |
| 19 | ORF11_10_76403646_76410014_ 76489182_76492128_RR | C10orf11; rs10509373; rs11593840 |

TABLE 2.a1-continued

| | Probe | GeneLocus |
|---|---|---|
| 20 | ORF11_16_69148710_69150217_<br>69228303_69232126_FF | CHTF8; CIRH1A;<br>SNTB2; rs119465999 |
| 21 | ORF11_18_5035567_5037467_<br>5050686_5056562_FR | C18orf42 |
| 22 | ORF11_22_36707726_36712518_<br>36755709_36758053_RR | IFT27; rs5750285 |
| 23 | ORF110_14_25790070_25797847_<br>25830955_25834255_RF | rs12586774; rs862946 |
| 24 | ORF111_13_34426191_34433129_<br>34463898_34472100_RR | NA |
| 25 | ORF111_17_76272094_76274120_<br>76321002_76322427_RF | PRPSAP1; QRICH2;<br>UBALD2 |
| 26 | ORF114_3_171158407_171161714_<br>171201848_171211535_RF | rs886037841; rs9810566;<br>TNIK |
| 27 | ORF115_15_59259334_59261999_<br>59275124_59282145_RF | MYO1E |
| 28 | ORF115_5_157440866_157447858_<br>157477057_157480958_RR | ADAM19; NIPAL4;<br>rs1990950; rs199422216;<br>rs199422217;<br>rs370356566; rs375688767;<br>rs775903553 |
| 29 | ORF115_9_28293258_28294446_<br>28333777_28339631_FF | LINGO2; rs10812774;<br>rs7851437 |
| 30 | ORF115_X_11308524_11309949_<br>11364232_11365389_RF | AMELX; ARHGAP6 |
| 31 | ORF118_18_11071108_11073538_<br>11120542_11126658_RF | PIEZO2; rs7228002 |
| 32 | ORF12_10_76413183_76419817_<br>76444465_76451876_FR | C10orf11 |
| 33 | ORF12_3_46807202_46811416_<br>46833087_46839270_RF | PRSS42; PRSS45;<br>PRSS50 |
| 34 | ORF120_11_110486946_110488037_<br>110506292_110507507_RR | ARHGAP20; FDX1 |
| 35 | ORF121_3_152326283_152334449_<br>152437463_152442012_RR | MBNL1; TMEM14E;<br>rs185894411 |
| 36 | ORF121_3_182183246_182185848_<br>182234332_182242013_FR | NA |
| 37 | ORF121_5_68461134_68466125_<br>68476885_68484945_RR | rs113246091; rs11960179 |
| 38 | ORF122_5_7483303_7486792_<br>7540900_7542383_RF | ADCY2; rs11948030;<br>rs13166360; rs17231202;<br>rs17826395; rs17826816;<br>rs34043481 |
| 39 | ORF123_15_80750227_80752685_<br>80777715_80785550_FR | ABHD17C; CEMIP;<br>rs11634851 |
| 40 | ORF124_2_66470757_66475654_<br>66492459_66494190_RF | MEIS1; rs11692361 |
| 41 | ORF125_9_28270698_28275294_<br>28333777_28339631_RF | LINGO2; rs10812774;<br>rs7357773 |
| 42 | ORF127_12_10377744_10380286_<br>10447112_10449189_RF | KLRC1; KLRC2; KLRC3;<br>KLRC4; KLRC4-KLRK1;<br>KLRK1; RP11-277P12.6;<br>rs11053781; rs11053802;<br>rs2617167; rs2617170;<br>rs7298732; rs77926410 |
| 43 | ORF127_16_59884617_59887309_<br>59942777_59950107_RF | NA |
| 44 | ORF13_1_117665372_117667932_<br>117692654_117695846_FR | NA |
| 45 | ORF13_1_13894526_13898185_<br>13945271_13952984_RF | rs7542939 |
| 46 | ORF13_12_10157054_10158072_<br>10186674_10187896_FR | GABARAPL1;<br>OLR1; TMEM52B |
| 47 | ORF13_12_13275230_13278281_<br>13314398_13317948_FR | EMP1; rs1479119 |
| 48 | ORF13_13_110945253_110947067_<br>110985607_110990896_RF | ANKRD10 |
| 49 | ORF13_18_3861153_3868188_<br>3881709_3884399_RF | DLGAP1 |
| 50 | ORF13_2_104860979_104864045_<br>104879992_104882471_RR | POU3F3; rs1005999 |
| 51 | ORF13_2_16010255_16015979_<br>16048422_16049999_RF | MYCN |
| 52 | ORF13_4_112301960_112303526_<br>112315696_112317586_FR | ALPK1; TIFA |
| 53 | ORF13_6_137232223_137235679_<br>137362789_137365756_RR | IFNGR1; rs13201877 |
| 54 | ORF130_1_181484002_181486199_ | CACNA1E; rs679931 |

TABLE 2.a1-continued

| | Probe | GeneLocus |
|---|---|---|
| | 181499646_181512034_RF | |
| 55 | ORF131_1_11226037_11228251_<br>11269663_11271072_RR | MTOR; UBIAD1 |
| 56 | ORF132_11_45973750_45978097_<br>46033363_46036668_RF | GYLTL1B; PHF21A |
| 57 | ORF133_1_103373638_103377704_<br>103450404_103453588_RF | RNPC3 |
| 58 | ORF134_4_22970139_22978081_<br>22994756_23003981_RF | rs358231 |
| 59 | ORF135_21_30984126_30988102_<br>30998437_31002269_FF | KRTAP19-8 |
| 60 | ORF137_12_46952555_46954006_<br>47024050_47025718_RF | AMIGO2; SLC38A4 |
| 61 | ORF137_5_36109952_36117110_<br>36160830_36164969_RF | LMBRD2; SKP2 |
| 62 | ORF138_15_65573794_65596385_<br>65611369_65614380_RF | PTPLAD1; SLC24A1;<br>VWA9; rs11632310;<br>rs12906196; rs4366668;<br>rs6494529; rs7165102;<br>rs7178686 |
| 63 | ORF138_2_87446096_87451261_<br>87563076_87564920_RF | PLGLB2 |
| 64 | ORF138_3_193187039_193193958_<br>193232024_193235318_FR | HRASLS |
| 65 | ORF139_2_121377681_121382516_<br>121420995_121425842_FF | CLASP1; rs62151096 |
| 66 | ORF14_10_80184350_80188816_<br>80268946_80271961_RF | ANXA11; MAT1A;<br>rs10887710; rs1298908;<br>rs2819941; rs3851059;<br>rs7087728 |
| 67 | ORF14_6_154154477_154163186_<br>154202548_154212736_RR | CNKSR3; IPCEF1;<br>OPRM1; rs2236256;<br>rs4869818 |
| 68 | ORF140_3_169107708_169110909_<br>169149123_169152499_RR | MECOM; rs12491785;<br>rs2901381; rs864309724 |
| 69 | ORF141_1_77409324_77410804_<br>77425166_77437348_FR | AK5 |
| 70 | ORF143_2_21321954_21323411_<br>21382106_21387178_FF | rs11897825; rs2337901 |
| 71 | ORF143_6_146066540_146070987_<br>146155392_146161780_FR | GRM1; SHPRH |
| 72 | ORF143_7_96186525_96189162_<br>96249981_96253639_FF | SLC25A13; rs1060499612;<br>rs746155190;<br>rs763191789; rs80338716;<br>rs80338717;<br>rs80338718; rs80338719;<br>rs80338720;<br>rs879255504 |
| 73 | ORF144_2_227875567_227878014_<br>227923203_227932124_RF | DAW1; rs113776284;<br>rs7591163 |
| 74 | ORF144_3_16438382_16444965_<br>16548225_16551831_FF | RFTN1 |
| 75 | ORF146_9_8811961_8818994_<br>8830500_8836449_FR | PTPRD; rs10120450;<br>rs10120501; rs10121203;<br>rs10758996; rs10815964;<br>rs1434254; rs1836229;<br>rs1975197; rs2053125;<br>rs7048621 |
| 76 | ORF147_21_30947497_30949256_<br>30984126_30988102_RF | KRTAP19-8; rs8134605 |
| 77 | ORF148_1_229796281_229797522_<br>229849427_229855718_FF | rs4925506 |
| 78 | ORF149_6_149229853_149231712_<br>149287970_149291658_FR | TAB2 |
| 79 | ORF15_1_65274536_65277437_<br>65337853_65339914_FR | DNAJC6; rs2477786 |
| 80 | ORF15_12_98974145_98977016_<br>99003375_99005607_FR | ANKS1B; rs7960581 |
| 81 | ORF15_14_90615204_90618493_<br>90720884_90724855_FR | RPS6KA5; TTC7B |
| 82 | ORF15_15_33922077_33935249_<br>33988276_33992735_FR | AVEN; CHRM5;<br>RYR3; rs661968 |

TABLE 2.a2

| | Probe_Count_Total | Probe_Count_Sig | HyperG_Stats |
|---|---|---|---|
| 1 | 38 | 1 | 0.340322106 |
| 2 | 54; 59 | 1; 1 | 0.232508672; 0.204801276 |
| 3 | 63; 57 | 3; 3; 3; 3 | 0.216848517; 0.224771745; 0.202795213; 0.214348844 |
| 4 | 107 | 2; 3 | 0.132213333; 0.169050538 |
| 5 | 19 | 2 | 0.132230242 |
| 6 | NA | NA | NA |
| 7 | 137; 107 | 1; 1 | 0.016382008; 0.046814166 |
| 8 | 163; 163; 140 | 4; 2; 4; 2; 4; 2 | 0.117375195; 0.022678142; 0.117375195; 0.022678142; 0.158806697; 0.045194146 |
| 9 | 26 | 1 | 0.373699919 |
| 10 | 23 | 1; 1 | 0.374075448; 0.376115439 |
| 11 | 27 | 1 | 0.37173223 |
| 12 | 143 | 3; 2 | 0.107765005; 0.041422991 |
| 13 | 30 | 1 | 0.363021342 |
| 14 | NA | NA | NA |
| 15 | 33 | 4; 2 | 0.029769861; 0.246924146 |
| 16 | NA | NA | NA |
| 17 | 22; 12 | 1; 1 | 0.375573766; 0.314913912 |
| 18 | 65 | 1; 2 | 0.198659276; 0.245566966 |
| 19 | 76 | 4; 4 | 0.169506823; 0.182516854 |
| 20 | 45; 65; 58 | 1; 1; 1 | 0.305019886; 0.198659276; 0.234279681 |
| 21 | 13 | 1 | 0.32680192 |
| 22 | 28 | 1 | 0.373281001 |
| 23 | NA | NA | NA |
| 24 | NA | NA | NA |
| 25 | 19; 24; 36 | 1; 1; 1 | 0.369026848; 0.375945017; 0.336492635 |
| 26 | NA; 41 | NA; 1 | NA; 0.325868449 |
| 27 | 45 | 1; 2 | 0.305019886; 0.276375861 |
| 28 | 33; 11 | 1; 1 | 0.360592644; 0.288260522 |
| 29 | 20 | 6; 4 | 7.69e−05; 0.007618647 |
| 30 | 33; 35 | 1; 3; 1; 3 | 0.360592644; 0.112054294; 0.353195365; 0.123360639 |
| 31 | 67 | 1; 1 | 0.189085999; 0.164740427 |
| 32 | 76 | 4; 4 | 0.169506823; 0.182516854 |
| 33 | 2; 2; 2 | 1; 1; 1 | 0.080664005; 0.080664005; 0.080664005 |
| 34 | 23; 23 | 1; 1 | 0.376115439; 0.376115439 |
| 35 | 27; 21 | 2; 1; 2; 1 | 0.197546356; 0.37173223; 0.149991246; 0.37425716 |
| 36 | NA | NA | NA |
| 37 | NA | NA | NA |
| 38 | 90 | 3; 3 | 0.219233776; 0.208104371 |
| 39 | 40; 46 | 1; 1 | 0.330827809; 0.299630226 |
| 40 | 57 | 4; 2 | 0.110951788; 0.26588291 |
| 41 | 20 | 6; 4 | 7.69e−05; 0.007618647 |
| 42 | 6; 12; 12; 22; 22; 22; 12 | 1; 1; 1; 1; 1; 1; 1 | 0.191789359; 0.302214299; 0.302214299; 0.372324987; 0.372324987; 0.372324987; 0.302214299 |

TABLE 2.a2-continued

| | Probe_Count_Total | Probe_Count_Sig | HyperG_Stats |
|---|---|---|---|
| 43 | NA | NA | NA |
| 44 | NA | NA | NA |
| 45 | NA | NA | NA |
| 46 | 29; 79; 59 | 2; 2; 2; 3; 2; 2 | 0.211050406; 0.22548219; 0.219227; 0.224909805; 0.269881341; 0.261532562 |
| 47 | 58 | 1; 3 | 0.234279681; 0.216530763 |
| 48 | 26 | 1 | 0.373699919 |
| 49 | 53 | 1 | 0.238249082 |
| 50 | 86 | 1 | 0.11379092 |
| 51 | 63 | 1 | 0.184056651 |
| 52 | 11; 11 | 1; 1 | 0.301350316; 0.301350316 |
| 53 | 93 | 2 | 0.17427462 |
| 54 | 32 | 1 | 0.363856051 |
| 55 | 45; 53 | 1; 1 | 0.285503815; 0.238249082 |
| 56 | 29; 28 | 1; 1 | 0.366349054; 0.369266824 |
| 57 | 14 | 1 | 0.325643034 |
| 58 | NA | NA | NA |
| 59 | 60 | 2; 2 | 0.268298503; 0.259153243 |
| 60 | 23; 23 | 1; 1; 1; 1 | 0.374075448; 0.376115439; 0.374075448; 0.376115439 |
| 61 | 16; 16 | 1; 2; 1; 2 | 0.343724359; 0.116490918; 0.343724359; 0.116490918 |
| 62 | 18; 25; 18 | 1; 1; 1; 1; 1 | 0.357137933; 0.364965787; 0.375519541; 0.357137933; 0.364965787 |
| 63 | 18 | 1 | 0.357137933 |
| 64 | 7 | 1 | 0.215038813 |
| 65 | 33 | 1 | 0.360592644 |
| 66 | 69; 20 | 1; 1 | 0.179812261; 0.366490901 |
| 67 | 163; 163; 140 | 4; 2; 4; 2; 4; 2 | 0.117375195; 0.022678142; 0.117375195; 0.022678142; 0.158806697; 0.045194146 |
| 68 | 22 | 1 | 0.372324987 |
| 69 | 23 | 1; 1 | 0.374075448; 0.376115439 |
| 70 | NA | NA | NA |
| 71 | 28; 28 | 1; 2; 1; 2 | 0.373281001; 0.219149094; 0.373281001; 0.219149094 |
| 72 | 33 | 1 | 0.360592644 |
| 73 | 38 | 2; 1 | 0.255573168; 0.325888812 |
| 74 | 55 | 2; 3 | 0.274632664; 0.209439509 |
| 75 | 59 | 1 | 0.229012733 |
| 76 | 60 | 2; 2 | 0.268298503; 0.259153243 |
| 77 | NA | NA | NA |
| 78 | 26 | 1; 2 | 0.375314357; 0.205329626 |
| 79 | 95 | 1 | 8.78E−02 |
| 80 | 110 | 2; 1 | 0.124006577; 0.042275815 |
| 81 | 88; 76 | 2; 1 | 0.167789783; 0.126761755 |
| 82 | 18; 18; 21 | 1; 1; 1 | 0.357137933; 0.357137933; 0.369816322 |

TABLE 2.a3

| | FDR_HyperG | Percent_Sig | logFC | AveExpr |
|---|---|---|---|---|
| 1 | 0.375519541 | 2.63 | −0.709015088 | −0.709015088 |
| 2 | 0.376115439; 0.376115439 | 1.85; 169 | −0.621824228 | −0.621824228 |
| 3 | 0.375519541; 0.376115439; 0.375519541; 0.376115439 | 4.76; 4.76; 5.26; 5.26 | −0.894408824 | −0.894408824 |
| 4 | 0.375519541; 0.376115439 | 1.87; 2.8 | −0.762732385 | −0.762732385 |
| 5 | 0.375519541 | 10.53 | −0.721208009 | −0.721208009 |
| 6 | NA | NA | −0.721031531 | −0.721031531 |
| 7 | 0.376115439; 0.376115439 | 0.73; 0.93 | −0.677555948 | −0.677555948 |
| 8 | 0.375519541; 0.376115439; 0.375519541; 0.376115439; 0.375519541; 0.376115439 | 2.45; 1.23; 2.45; 1.23; 2.86; 1.43 | −0.627203595 | −0.627203595 |
| 9 | 0.376115439 | 3.85 | −0.673868285 | −0.673868285 |
| 10 | 0.375519541; 0.376115439 | 4.35; 4.35 | −0.755709116 | −0.755709116 |
| 11 | 0.376115439 | 3.7 | −0.715992935 | −0.715992935 |
| 12 | 0.375519541; 0.376115439 | 2.1; 1.4 | −0.713103765 | −0.713103765 |
| 13 | 0.376115439 | 3.33 | −0.624335514 | −0.624335514 |
| 14 | NA | NA | −0.725440143 | −0.725440143 |
| 15 | 0.375519541; 0.376115439 | 12.12; 6.06 | −0.731354707 | −0.731354707 |
| 16 | NA | NA | −0.63602694 | −0.63602694 |

TABLE 2.a3-continued

| | FDR_HyperG | Percent_Sig | logFC | AveExpr |
|---|---|---|---|---|
| 17 | 0.376115439; 0.376115439 | 4.55; 8.33 | −0.676084413 | −0.676084413 |
| 18 | 0.375519541; 0.376115439 | 1.54; 3.08 | −0.77604852 | −0.77604852 |
| 19 | 0.375519541; 0.376115439 | 5.26; 5.26 | −0.835298815 | −0.835298815 |
| 20 | 0.375519541; 0.375519541; 0.375519541 | 2.22; 1.54; 1.72 | −0.717714737 | −0.717714737 |
| 21 | 0.376115439 | 7.69 | −0.873959367 | −0.873959367 |
| 22 | 0.375519541 | 3.57 | −0.920838995 | −0.920838995 |
| 23 | NA | NA | −0.973608142 | −0.973608142 |
| 24 | NA | NA | −0.700803469 | −0.700803469 |
| 25 | 0.376115439; 0.376115439; 0.376115439 | 5.26; 4.17; 2.78 | −0.735783774 | −0.735783774 |
| 26 | NA; 0.375519541 | NA; 2.44 | −0.789035477 | −0.789035477 |
| 27 | 0.375519541; 0.376115439 | 2.22; 4.44 | −0.725069084 | −0.725069084 |
| 28 | 0.375519541; 0.375519541 | 3.03; 9.09 | −0.758076547 | −0.758076547 |
| 29 | 0.008046243; 0.242844385 | 30; 20 | −0.758831154 | −0.758831154 |
| 30 | 0.375519541; 0.376115439; 0.375519541; 0.376115439 | 3.33; 9.09; 2.86; 8.57 | −0.858662527 | −0.858662527 |
| 31 | 0.375519541; 0.376115439 | 1.49; 1.49 | −0.713531849 | −0.713531849 |
| 32 | 0.375519541; 0.376115439 | 5.26; 5.26 | −0.747196209 | −0.747196209 |
| 33 | 0.376115439; 0.376115439; 0.376115439 | 50; 50; 50 | −0.683750198 | −0.683750198 |
| 34 | 0.376115439; 0.376115439 | 4.35; 4.35 | −0.633467879 | −0.633467879 |
| 35 | 0.375519541; 0.376115439; 0.375519541; 0.376115439 | 7.41; 3.7; 9.52; 4.76 | −1.009591423 | −1.009591423 |
| 36 | NA | NA | −0.909959217 | −0.909959217 |
| 37 | NA | NA | −0.889155137 | −0.889155137 |
| 38 | 0.375519541; 0.376115439 | 3.33; 3.33 | −0.814799341 | −0.814799341 |
| 39 | 0.375519541; 0.375519541 | 2.5; 2.17 | −0.708835683 | −0.708835683 |
| 40 | 0.375519541; 0.376115439 | 7.02; 3.51 | −0.803329367 | −0.803329367 |
| 41 | 0.008046243; 0.242844385 | 30; 20 | −0.754448335 | −0.754448335 |
| 42 | 0.375519541; 0.375519541; 0.375519541; 0.375519541; 0.375519541; 0.375519541; 0.375519541 | 16.67; 8.33; 8.33; 4.55; 4.55; 4.55; 8.33 | −1.064914096 | −1.064914096 |
| 43 | NA | NA | −0.633762538 | −0.633762538 |
| 44 | NA | NA | −0.759251905 | −0.759251905 |
| 45 | NA | NA | −0.723893836 | −0.723893836 |
| 46 | 0.375519541; 0.376115439; 0.375519541; 0.376115439; 0.375519541; 0.376115439 | 6.9; 6.9; 2.53; 3.8; 3.39; 3.39 | −0.737400601 | −0.737400601 |
| 47 | 0.375519541; 0.376115439 | 1.72; 5.17 | −0.704474086 | −0.704474086 |
| 48 | 0.376115439 | 3.85 | −0.750143066 | −0.750143066 |
| 49 | 0.376115439 | 1.89 | −0.635359265 | −0.635359265 |
| 50 | 0.375519541 | 1.16 | −0.858388718 | −0.858388718 |
| 51 | 0.376115439 | 1.59 | −0.690345488 | −0.690345488 |
| 52 | 0.376115439; 0.376115439 | 9.09 | −0.738998838 | −0.738998838 |
| 53 | 0.375519541 | 2.15 | −0.881183365 | −0.881183365 |
| 54 | 0.375519541 | 3.12 | −0.902920687 | −0.902920687 |
| 55 | 0.376115439; 0.376115439 | 2.22; 1.89 | −0.624635912 | −0.624635912 |
| 56 | 0.376115439; 0.376115439 | 3.45; 3.57 | −0.706506109 | −0.706506109 |
| 57 | 0.375519541 | 7.14 | −0.778372431 | −0.778372431 |
| 58 | NA | NA | −0.775027142 | −0.775027142 |
| 59 | 0.375519541; 0.376115439 | 3.33; 3.33 | −0.656602933 | −0.656602933 |
| 60 | 0.375519541; 0.376115439; 0.375519541; 0.376115439 | 4.35; 4.35; 4.35; 4.35 | −0.780315542 | −0.780315542 |
| 61 | 0.375519541; 0.376115439; 0.375519541; 0.376115439 | 6.25; 12.5; 6.25; 12.5 | −0.636456185 | −0.636456185 |
| 62 | 0.375519541; 0.376115439; 0.375519541; 0.375519541; 0.376115439 | 5.56; 5.56; 4; 5.56; 5.56 | −0.848473602 | −0.848473602 |
| 63 | 0.375519541 | 5.56 | −0.735464874 | −0.735464874 |
| 64 | 0.375519541 | 14.29 | −0.710935297 | −0.710935297 |
| 65 | 0.375519541 | 3.03 | −0.757426234 | −0.757426234 |
| 66 | 0.375519541; 0.375519541 | 1.45; 5 | −0.782417152 | −0.782417152 |
| 67 | 0.375519541; 0.376115439; 0.375519541; 0.376115439; 0.375519541; 0.376115439 | 2.45; 1.23; 2.45; 1.23; 2.86; 1.43 | −0.723846597 | −0.723846597 |
| 68 | 0.375519541 | 4.55 | −0.716912676 | −0.716912676 |
| 69 | 0.375519541; 0.376115439 | 4.35; 4.35 | −0.631116211 | −0.631116211 |
| 70 | NA | NA | −0.737171153 | −0.737171153 |
| 71 | 0.375519541; 0.376115439; 0.375519541; 0.376115439 | 3.57; 7.14; 3.57; 7.14 | −0.634695914 | −0.634695914 |
| 72 | 0.375519541 | 3.03 | −0.782317451 | −0.782317451 |
| 73 | 0.375519541; 0.376115439 | 5.26; 2.63 | −0.707018011 | −0.707018011 |
| 74 | 0.375519541; 0.376115439 | 3.64; 5.45 | −0.703124305 | −0.703124305 |
| 75 | 0.375519541 | 1.69 | −0.790013857 | −0.790013857 |
| 76 | 0.375519541; 0.376115439 | 3.33; 3.33 | −0.808156687 | −0.808156687 |
| 77 | NA | NA | −0.964755594 | −0.964755594 |
| 78 | 0.375519541; 0.376115439 | 3.85; 7.69 | −0.966851209 | −0.966851209 |
| 79 | 0.375519541 | 1.05 | −0.808919098 | −0.808919098 |
| 80 | 0.375519541; 0.376115439 | 1.82; 0.91 | −0.705391936 | −0.705391936 |
| 81 | 0.376115439; 0.376115439 | 2.27; 1.32 | −0.624286859 | −0.624286859 |
| 82 | 0.375519541; 0.375519541; 0.375519541 | 5.56; 5.56; 4.76 | −0.764247064 | −0.764247064 |

TABLE 2.a4

| | t | P. Value | adj. P. Val | B | FC | FC_1 | LS |
|---|---|---|---|---|---|---|---|
| 1 | −6.967290763 | 0.0000151 | 0.000229077 | 3.208783547 | 0.611737623 | −1.634687753 | −1 |
| 2 | −11.80406641 | 0.0000000613 | 0.0000138 | 8.841413549 | 0.649848701 | −1.538819725 | −1 |
| 3 | −7.314953251 | 0.0000000957 | 0.000307261 | 3.752834712 | 0.537967594 | −1.858848025 | −1 |
| 4 | −3.262995276 | 0.00683472 | 0.02833772 | −2.957420767 | 0.589379022 | −1.696701042 | −1 |
| 5 | −4.968029649 | 0.00032784 | 0.001952136 | 0.032233108 | 0.606589315 | −1.648561843 | −1 |
| 6 | −11.8131196 | 0.0000000608 | 0.0000138 | 8.849745674 | 0.606663521 | −1.648360196 | −1 |
| 7 | −13.12001115 | 0.0000000189 | 0.00000773 | 9.988600988 | 0.625223561 | −1.599427888 | −1 |
| 8 | −6.084970954 | 0.0000558 | 0.000984165 | 1.941696022 | 0.647430127 | −1.544568222 | −1 |
| 9 | −11.85428208 | 0.0000000585 | 0.0000136 | 8.887548932 | 0.626823735 | −1.595344822 | −1 |
| 10 | −5.556841306 | 0.000125107 | 0.000969049 | 1.025796947 | 0.592255207 | −1.688461304 | −1 |
| 11 | −4.638823995 | 0.000579337 | 0.004984216 | −0.459547887 | 0.60878599 | −1.642613358 | −1 |
| 12 | −7.76455057 | 0.00000515 | 0.000112934 | 4.322293383 | 0.610006379 | −1.639327119 | −1 |
| 13 | −9.506384582 | 0.000000644 | 0.0000565 | 6.498451369 | 0.6487185 | −1.541500667 | −1 |
| 14 | −6.028359188 | 0.0000599 | 0.000577932 | 1.78673893 | 0.604812498 | −1.653404987 | −1 |
| 15 | −5.316223813 | 0.000184376 | 0.001280565 | 0.625473386 | 0.602338046 | −1.660197304 | −1 |
| 16 | −4.915794296 | 0.000361906 | 0.003583857 | 0.022198152 | 0.643482608 | −1.554043556 | −1 |
| 17 | −10.76833726 | 0.000000168 | 0.0000254 | 7.843989171 | 0.625861609 | −1.597797318 | −1 |
| 18 | −9.577396732 | 0.000000595 | 0.0000541 | 6.578326186 | 0.583964057 | −1.71243416 | −1 |
| 19 | −6.8024921 | 0.0000191 | 0.000267386 | 2.96804814 | 0.560466942 | −1.784226554 | −1 |
| 20 | −5.724026908 | 0.000096 | 0.000804138 | 1.299193768 | 0.608059861 | −1.644574925 | −1 |
| 21 | −8.397996218 | 0.00000236 | 0.000126895 | 5.180897834 | 0.545647306 | −1.832685671 | −1 |
| 22 | −8.371982571 | 0.00000238 | 0.0000689 | 5.116567055 | 0.528201757 | −1.893215967 | −1 |
| 23 | −8.769438097 | 0.00000147 | 0.000051 | 5.612539925 | 0.509230896 | −1.963745735 | −1 |
| 24 | −7.105211691 | 0.0000127 | 0.000368733 | 3.458758895 | 0.615229476 | −1.625409768 | −1 |
| 25 | −4.384395187 | 0.000900518 | 0.00678304 | −0.910104779 | 0.600491707 | −1.665301934 | −1 |
| 26 | −8.592211463 | 0.00000182 | 0.000058 | 5.393630836 | 0.578730877 | −1.727918865 | −1 |
| 27 | −4.491034086 | 0.000747760 | 0.005934743 | −0.720381163 | 0.604968075 | −1.652979788 | −1 |
| 28 | −7.813359983 | 0.00000483 | 0.000108342 | 4.387795349 | 0.591284127 | −1.691234306 | −1 |
| 29 | −8.336490328 | 0.00000249 | 0.0000707 | 5.071383935 | 0.590974934 | −1.692119144 | −1 |
| 30 | −9.409816538 | 0.000000718 | 0.0000605 | 6.388990029 | 0.551463564 | −1.813356431 | −1 |
| 31 | −5.161266549 | 0.000237704 | 0.001542225 | 0.363462055 | 0.609825402 | −1.63981362 | −1 |
| 32 | −6.206849598 | 0.0000465 | 0.000869076 | 2.130649345 | 0.595760257 | −1.678527542 | −1 |
| 33 | −7.565911003 | 0.00000684 | 0.00024651 | 4.097023669 | 0.622544902 | −1.606309838 | −1 |
| 34 | −4.169100205 | 0.001316153 | 0.008687522 | −1.296693484 | 0.644625034 | −1.551289428 | −1 |
| 35 | −8.029186511 | 0.00000366 | 0.0000901 | 4.673872264 | 0.496686892 | −2.013340833 | −1 |
| 36 | −4.467590389 | 0.000771749 | 0.003675953 | −0.847309931 | 0.532200136 | −1.878992381 | −1 |
| 37 | −4.961829562 | 0.000331268 | 0.001966927 | 0.021524681 | 0.539930217 | −1.852091195 | −1 |
| 38 | −5.793538403 | 0.0000861 | 0.000744278 | 1.411706775 | 0.56848755 | −1.759053474 | −1 |
| 39 | −7.545860128 | 0.00000687 | 0.000135682 | 4.02510253 | 0.6118137 | −1.634484485 | −1 |
| 40 | −12.84573625 | 0.0000000229 | 0.00000441 | 9.80966493 | 0.573025257 | −1.745123777 | −1 |
| 41 | −5.670620457 | 0.000104442 | 0.000853663 | 1.212285842 | 0.59277301 | −1.686986391 | −1 |
| 42 | −7.955068433 | 0.00000402 | 0.000096 | 4.57627957 | 0.47800112 | −2.092045307 | −1 |
| 43 | −8.733628985 | 0.00000157 | 0.0000989 | 5.594405878 | 0.644493388 | −1.551606299 | −1 |
| 44 | −8.772524916 | 0.0000015 | 0.0000959 | 5.64148614 | 0.590802606 | −1.692612709 | −1 |
| 45 | −5.968706186 | 0.0000656 | 0.000616454 | 1.692207073 | 0.605461094 | −1.651633787 | −1 |
| 46 | −7.374301451 | 0.00000883 | 0.000292636 | 3.834979572 | 0.599819113 | −1.667169282 | −1 |
| 47 | −10.95636749 | 0.000000134 | 0.0000117 | 8.045169198 | 0.613666151 | −1.629550527 | −1 |
| 48 | −8.951544726 | 0.00000122 | 0.000084 | 5.855865648 | 0.594544596 | −1.681959615 | −1 |
| 49 | −8.483073194 | 0.00000213 | 0.000119366 | 5.286958721 | 0.643780478 | −1.553324516 | −1 |
| 50 | −8.696309388 | 0.0000016 | 0.0000538 | 5.522644501 | 0.551568236 | −1.813012307 | −1 |
| 51 | −6.774937383 | 0.0000203 | 0.000503919 | 2.983571955 | 0.619705429 | −1.613669905 | −1 |
| 52 | −7.132628726 | 0.0000123 | 0.000360453 | 3.497536145 | 0.599154993 | −1.669017218 | −1 |
| 53 | −13.84645685 | 0.00000000985 | 0.00000282 | 10.64128454 | 0.542921919 | −1.841885481 | −1 |
| 54 | −9.38731335 | 0.000000715 | 0.0000326 | 6.348570481 | 0.534802944 | −1.869847597 | −1 |
| 55 | −7.005818947 | 0.0000146 | 0.000404802 | 3.317327772 | 0.648583438 | −1.541821672 | −1 |
| 56 | −9.544081111 | 0.000000617 | 0.0000552 | 6.540917528 | 0.612802416 | −1.631847351 | −1 |
| 57 | −6.081742554 | 0.0000552 | 0.000545563 | 1.870907921 | 0.583024158 | −1.715194793 | −1 |
| 58 | −7.970534443 | 0.00000394 | 0.0000949 | 4.596699819 | 0.58437763 | −1.711222245 | −1 |
| 59 | −6.768401626 | 0.0000204 | 0.000506812 | 2.974016889 | 0.634370271 | −1.576366432 | −1 |
| 60 | −10.05083213 | 0.000000355 | 0.0000393 | 7.097798334 | 0.582239433 | −1.71750648 | −1 |
| 61 | −7.285563893 | 0.0000996 | 0.000315494 | 3.711983185 | 0.643291181 | −1.554506 | −1 |
| 62 | −13.20468402 | 0.0000000168 | 0.00000376 | 10.11545576 | 0.555372019 | −1.800594855 | −1 |
| 63 | −5.640110527 | 0.000109603 | 0.000882937 | 1.162457071 | 0.600624457 | −1.664933868 | −1 |
| 64 | −7.048483109 | 0.0000135 | 0.000212228 | 3.326030289 | 0.610923949 | −1.636864951 | −1 |
| 65 | −4.702742971 | 0.000514004 | 0.002723042 | −0.430286806 | 0.591550716 | −1.690472133 | −1 |
| 66 | −6.609249636 | 0.0000252 | 0.000320879 | 2.681009587 | 0.581391888 | −1.720010238 | −1 |
| 67 | −5.139253674 | 0.000246507 | 0.001584564 | 0.325978778 | 0.60548092 | −1.651579706 | −1 |
| 68 | −4.285466904 | 0.00106235 | 0.004663639 | −1.174419268 | 0.608398003 | −1.643660884 | −1 |
| 69 | −5.163922573 | 0.000239554 | 0.002683371 | 0.445384777 | 0.645676663 | −1.548762806 | −1 |
| 70 | −10.21087399 | 0.00000029 | 0.0000186 | 7.268136783 | 0.599914517 | −1.666904155 | −1 |
| 71 | −8.950411064 | 0.00000122 | 0.000084 | 5.854625604 | 0.644076557 | −1.552610462 | −1 |
| 72 | −5.574745047 | 0.000121588 | 0.000949047 | 1.055262273 | 0.581432068 | −1.719891377 | −1 |
| 73 | −4.350938497 | 0.000946609 | 0.004268251 | −1.056437739 | 0.612585018 | −1.632426472 | −1 |
| 74 | −11.41048444 | 0.000000891 | 0.0000173 | 8.47287641 | 0.614240564 | −1.628026637 | −1 |
| 75 | −7.480222038 | 0.00000749 | 0.000143287 | 3.934706397 | 0.578338537 | −1.729091071 | −1 |
| 76 | −7.948752109 | 0.00000405 | 0.0000965 | 4.567931437 | 0.571111093 | −1.750972817 | −1 |
| 77 | −3.798122869 | 0.00254516 | 0.008973828 | −2.064090726 | 0.512365204 | −1.951732852 | −1 |
| 78 | −13.63931618 | 0.0000000122 | 0.00000609 | 10.40829899 | 0.511621498 | −1.95456994 | −1 |

TABLE 2.a4-continued

| | t | P. Value | adj. P. Val | B | FC | FC_1 | LS |
|---|---|---|---|---|---|---|---|
| 79 | −8.037377146 | 0.00000362 | 0.0000895 | 4.684615618 | 0.570809362 | −1.751898387 | −1 |
| 80 | −9.289749362 | 0.000000799 | 0.0000348 | 6.235078318 | 0.613275858 | −1.630587585 | −1 |
| 81 | −6.240283826 | 0.0000442 | 0.000840053 | 2.182113056 | 0.648740378 | −1.541448681 | −1 |
| 82 | −5.232751927 | 0.000211328 | 0.001412883 | 0.484737935 | 0.58876056 | −1.698483336 | −1 |

TABLE 2.a5

| Loop Detected | Probe sequence 60 mer | Probe Location Chr |
|---|---|---|
| 1 sAD | AAACTCAATGATAGAATTATTAAGGATTTCGACATTTTAAAAGGGCACTTGGAATTTCAC (SEQ ID NO: 1082) | 16 |
| 2 mAD | TTTTCCAGTCCTATTTTCTATGGCAATGTCGAAAGTCTTTGAAAATAAACTCACCTAACG (SEQ ID NO: 1083) | 7 |
| 3 mAD | CTAAAATGAATCCTAAAGGTCTTTTTGTTCGATTTTGAAAAGCACATGTTTCCTTCCTTT (SEQ ID NO: 1084) | 8 |
| 4 mAD | ACTGAATTCTCACAACCATCCTGGTGTTTCGAATAAAAGAATCTGGATCTATTAAATGTC (SEQ ID NO: 1085) | 1 |
| 5 sAD | TAATGATAAAAAAATCAAATAAAAACTGTCGATAGTGATAAAGACATACTCATAAAATAT (SEQ ID NO: 1086) | 1 |
| 6 mAD | AGTTGAAGGCATCACATATGTTCTGATTTCGAAATGTTAAGTGTTTTAAAAACAACTTTC (SEQ ID NO: 1087) | 16 |
| 7 mAD | AATATGGAGAGCAAAAAAAAAAGCCTCTCGAAACAGAGGTATCAAGTCCTTTGTTGCAA (SEQ ID NO: 1088) | 5 |
| 8 mAD | TTCATGAGTCATAGTCAATTATATAATCTCGATGTGACAAGTGCTTTTAAACAAGAGATT (SEQ ID NO: 1089) | 6 |
| 9 mAD | TGTTTCACAAATAGAATAAGACCATTTCTCGATATTTCGTCTTACTCTGCCCCACCTCCA (SEQ ID NO: 1090) | 7 |
| 10 sAD | ACATTTATTCCCTAATACTCTTCTCTGTTCGAACCAGAAGAACATTGTCCTTAAACCAGA (SEQ ID NO: 1091) | 1 |
| 11 mAD | CCAGCTTATTCTAAGTCCTCAATAAATCTCGAGAACAGCTACTTTCTATCTTCTGTTACA (SEQ ID NO: 1092) | 2 |
| 12 sAD | AAACTTTAAAACAAAATGAAGTTCTAATTCGAAGGCTCTTTCTCTAGCTTTTTCCTTTGG (SEQ ID NO: 1093) | 4 |
| 13 mAD | GACTCAACTACAAATAACTACAACCTCTTCGACATTTGCATTTAAATTGCTTTGAGCCTT (SEQ ID NO: 1094) | 11 |
| 14 sAD | AACATTTGCAACTTGATGATATTATGTTTCGAAGGATAAAACCACTAAGCATTATATTTA (SEQ ID NO: 1095) | 21 |
| 15 sAD | CGTAATGTTATTTTTAAAAACGTACTTTTCGAGGCATTCCAATAAAAATAAGTAAATTCT (SEQ ID NO: 1096) | 18 |
| 16 mAD | GACCACAAAGTGAAGGTAAAAATAAAATTCGACTTTACAAATAATAATAATAGTCCAATG (SEQ ID NO: 1097) | X |
| 17 mAD | AAATATCAGGAGAATCCACATAGTAGTCTCGAACATCAGACTTGAATTTCTTGTTTTGGA (SEQ ID NO: 1098) | 7 |
| 18 mAD | CTATATTTGCTTCATAATTTTTTCTTTTTCGACTTAACAACTTGTATAGGTTTGGTATTA (SEQ ID NO: 1099) | 11 |
| 19 sAD | ACTCTTCAAAATTATAATTATCAACAATTCGATTTTGTTACTTGTTATTGGTCTTTTCAG (SEQ ID NO: 1100) | 10 |
| 20 sAD | TCTTTGTTAGGTTTTCTCTTATGTTCTTTCGAAGTCTAACTTGAATATCTATTACTTTTA (SEQ ID NO: 1101) | 16 |
| 21 mAD | AACAAAATAAAGCTTGACTTTTAACAAATCGATGTAGTCTTTGTGGCCAATCTTTATCAC (SEQ ID NO: 1102) | 18 |
| 22 sAD | CAATATCCTTTGTATTATTTTCTTTACTTCGAATCCATGGGCTCTGAAACAAAACCATTT | 22 |

TABLE 2.a5-continued

| Loop Detected | Probe sequence 60 mer | Probe Location Chr |
|---|---|---|
| | (SEQ ID NO: 1103) | |
| 23 sAD | GAATTATCAAATTATATTCCAGGTTTGTTCGATATCTCTGCTCAATTTTTAAAATGCTAT (SEQ ID NO: 1104) | 14 |
| 24 mAD | TACGTTAATTAAATAAATTTGTGCTCACTCGAAACAGGTTGGTTTTACACAAAGAGGTGT (SEQ ID NO: 1105) | 13 |
| 25 mAD | AAAAATATATTTATCAAACAACAGTCTTTCGAGAGGGGCCGGGCCCGGCACCCACCGCAT (SEQ ID NO: 1106) | 17 |
| 26 sAD | CCTAGAAGAGATCAAGGTAGAAAGACTATCGAGAGGACATAAATAAGTTCTACCTACTTC (SEQ ID NO: 1107) | 3 |
| 27 mAD | AGCCATAGGGAATTTAAATAACTTCTGTTCGATTATGTCACATGTAACATGAGTGATTCC (SEQ ID NO: 1108) | 15 |
| 28 sAD | TCAAATTCTCATTTTTTAAGGTTTATTTTCGAAGAATCTCAGGATCATTCAGGCCTTTAA (SEQ ID NO: 1109) | 5 |
| 29 sAD | CAGAAAATTCAAATAAACTGTTAAAATTTCGATAGATCCTAATATTACTATTTAGTGGGC (SEQ ID NO: 1110) | 9 |
| 30 mAD | ACTTGCAGACAAATGTCTTCAAATTCATTCGATGTTATAGAATCTTGATCCTTCATCATA (SEQ ID NO: 1111) | X |
| 31 sAD | ATATTTTTTTTTTTTGTATTCCCAGAATCGAAAAGAAGTTCTTTTTATCCCAAAGGAGT (SEQ ID NO: 1112) | 18 |
| 32 mAD | TATTGAGTITTAAGTGTTTTGTATATTTTCGATACTGGGTTCAAATCTCAATTTTATTTT (SEQ ID NO: 1113) | 10 |
| 33 mAD | CTACAGTATATCATCTAAGATGTCTTCTTCGACTAACGTTTACTTGGCACTTGATGTTTT (SEQ ID NO: 1114) | 3 |
| 34 mAD | AAAGAAGAAAAAAATGAAATAATTGGTTTCGACAGAAGCTAGTTATAATGTCGTTATTAT (SEQ ID NO: 1115) | 11 |
| 35 sAD | ATAATAATAAATAACATTAAAGTTAAACTCGAGATGCTCTTATTCTCTGGGCTTCATATT (SEQ ID NO: 1116) | 3 |
| 36 sAD | ACACCCATTTTTAGGAATATTACAGTTGTCGATTGTATTTTGACAGGAAAGCAGAATGTA (SEQ ID NO: 1117) | 3 |
| 37 sAD | TATTTTTCTTTATCTGAATTTATAACTTTCGATTTTTTTCATGCTCCTCTCCAATTCTGT (SEQ ID NO: 1118) | 5 |
| 38 sAD | TATTACAGAAAAAAAAAAATGGATCTCTTCGAAAAATTTTGAGAGTAGTCATCTGCTGGG (SEQ ID NO: 1119) | 5 |
| 39 sAD | TAGTACTAATTGGTATCCTTTTGTAACTTCGACCTTTCTCCATTTGGGCCAAATGCCCAG (SEQ ID NO: 1120) | 15 |
| 40 sAD | ACTCCTTTCAATCAGTTGAATCAACAAATCGAACACAGAAGTATTTATCTGAAAAGTGGA (SEQ ID NO: 1121) | 2 |
| 41 sAD | GCCCACTAAATAGTAATATTAGGATCTATCGAATTTGTGCTTGTTGGGAAAATAGTAATT (SEQ ID NO: 1122) | 9 |
| 42 sAD | CATATGGATGATTTCTACAAATATATTATCGAGACTTATCAAATTGTATACTTTATATAT (SEQ ID NO: 1123) | 12 |
| 43 mAD | CAAAATCCTGAGGAAAGTTTCTAATTTATCGAACTGCAAACCATCAAAGTTACCAGGAAA (SEQ ID NO: 1124) | 16 |
| 44 mAD | CTTGACTGTGTTGTATTTTTTGTTTTTTTCGACTGACTGATTAAAACATTCATTATCTGA (SEQ ID NO: 1125) | 1 |
| 45 sAD | TACATTTTTAGCTCATCATAAAAGATATTCGACTTTTTTGGCGTTAATTCTCACTGGGAA (SEQ ID NO: 1126) | 1 |
| 46 mAD | ACAGATTAAAACTATGAGGATATACCATTCGAGTAATATTAAAGATTCCAGGACTCACAA (SEQ ID NO: 1127) | 12 |
| 47 sAD | TTTTTTGTTGTTTTTTTTTTAATACTCCCTCGATAGTATATATAAGACAGGAATATGTGTG (SEQ ID NO: 1128) | 12 |

TABLE 2.a5-continued

| Loop Detected | Probe sequence 60 mer | Probe Location Chr |
|---|---|---|
| 48 mAD | TACAATTTTGATGAGCATTATAAAGAAATCGAATGCTGTTATTTTCCAGAGTTAATTAGG (SEQ ID NO: 1129) | 13 |
| 49 mAD | AATATATAAAATGATGTGGAATAATGTTTCGATTATTCAGGAAAAACTCCTTTACAAAAA (SEQ ID NO: 1130) | 18 |
| 50 sAD | GTTAAAATTATTTAAAATATTACACTTATCGAATGCATTTTGTGACTATAGAGGGTGGCT (SEQ ID NO: 1131) | 2 |
| 51 mAD | TATTTCATTCTTTCAACAAATATTTGACTCGAGTTGTTTCATTTTTTTAGACATTGGTTT (SEQ ID NO: 1132) | 2 |
| 52 mAD | TCTCTGAATGTCTTTTGAATCTACCATATCGAATAGCAAGCATGCAACAATGCTTGTGAC (SEQ ID NO: 1133) | 4 |
| 53 sAD | TTAAATCAAAATCTTTGACTCTTAAAAATCGAAAGGTAAGGCAGAGTGAGATGGAATCTA (SEQ ID NO: 1134) | 6 |
| 54 sAD | CATTTGCAGATTTGTTAATAGTATAAAATCGATTGGCCATATCCTTTCTTGCCCACCATA (SEQ ID NO: 1135) | 1 |
| 55 mAD | CACCTTGGTTATAATGTATTTTTAAATTTCGAGATCAGCTTGGTAAAACCCTATCTCTAC (SEQ ID NO: 1136) | 1 |
| 56 mAD | CTTTTAAAAGGTTTCTTGCTTTTCTGACTCGATTTAAAGAACTTCTGAAGTGGTGATCCA (SEQ ID NO: 1137) | 11 |
| 57 sAD | AGTCCTTATTGAGTGATCTTTATATTACTCGAAAAACTCTTATCAGGATAAGAATAATGG (SEQ ID NO: 1138) | 1 |
| 58 sAD | GTAAAAACAAAGCAAATTCTTCAAAATTTCGAGTTGTTTCCAATAATTTTAAAAGATGGC (SEQ ID NO: 1139) | 4 |
| 59 mAD | AATGAAACTGTAAGTTTCCCCAATTAAATCGAATGTTTAAAATTTTGGTGAATTGTTATT (SEQ ID NO: 1140) | 21 |
| 60 mAD | GAGACAACTCAATATTAATAATGCAGATTCGATGAGTTTCTGTATTCAGGATTGGTGTTT (SEQ ID NO: 1141) | 12 |
| 61 mAD | CAAACATTCTGACTACAATACAGTATTATCGATTTTCACCTTCTTCTTGCCTTTGCCTTT (SEQ ID NO: 1142) | 5 |
| 62 sAD | AACAATAAATCCCTAATATCATCAAATATCGATTTTAGTATGACAACTAAGAACATAAAA (SEQ ID NO: 1143) | 15 |
| 63 sAD | ATATTATGTTCTAGAAAAGGTAGAATTATCGAGATTTACTCATAGGCACTGAGTTTCAAA (SEQ ID NO: 1144) | 2 |
| 64 sAD | CTATATTATCTGCATTTTTCAAATTCATTCGACTTGGGTAGAAACAATAATAGCTAACAC (SEQ ID NO: 1145) | 3 |
| 65 sAD | GAACAAATTTTGTTTTACAATTTGGTCCTCGATGAATTTAATCCAGCCACATTTATTATG (SEQ ID NO: 1146) | 2 |
| 66 sAD | GGAAAGTATAAAATTCTGAATTTTCATGTCGACTTATGATTTTTCAACTTTATGATGGTG (SEQ ID NO: 1147) | 10 |
| 67 sAD | TTATATTGGAAATCTGTTTCAACAATAATCGAAACAACACCAAATAAGCTTTTCCTCTTA (SEQ ID NO: 1148) | 6 |
| 68 sAD | ATAGAAATTGTTTACAGAATGATTTTATTCGAGCTATGAGCTGTTCTATTTTCTTCCTGT (SEQ ID NO: 1149) | 3 |
| 69 mAD | ACATTTATTCCCTAATACTCTTCTCTGTTCGACAAAATTATCCTTCAAAAATGAAGGAGA (SEQ ID NO: 1150) | 1 |
| 70 sAD | CACAAAACTGAATTTATTITTATCGTCTTCGACAGAGCTACATTAAAAAGGAGAATCTCC (SEQ ID NO: 1151) | 2 |
| 71 mAD | CTGCTAATTTTAATTCACTAAGAAACTATCGATATACCATAGGTGTATAGTAGGTTATGC (SEQ ID NO: 1152) | 6 |
| 72 sAD | AATTTCTCTTTACAGCCTTTAAAATTTATCGATGTTATAGAGTCACTCTTATTGCTCCTG (SEQ ID NO: 1153) | 7 |

TABLE 2.a5-continued

| Loop Detected | Probe sequence 60 mer | Probe Location Chr |
|---|---|---|
| 73 sAD | TCTATATAAGAAATTCGTAGGATGAATATCGAATAATCTACCCATGGACATTTGTATCAC (SEQ ID NO: 1154) | 2 |
| 74 mAD | TTTAGTATTAGAAATGTTTTGGTCTTTATCGAAAAACATGGCTCTGAAACCCAAGCTTAT (SEQ ID NO: 1155) | 3 |
| 75 sAD | CACTCTAGTCCACTACTAGTTGCAATGTTCGAATCATGGACAGATGAGAGGTTTCAAGCA (SEQ ID NO: 1156) | 9 |
| 76 sAD | AATGAAACTGTAAGTTTCCCCAATTAAATCGAATCCGTAAATTCTAACACCTCCCTTCTT (SEQ ID NO: 1157) | 21 |
| 77 sAD | CTTAATCAATTGGAGTTTAACCTTTGGTTCGATTTTTCAATGTTTGTGACAAAACCGGTT (SEQ ID NO: 1158) | 1 |
| 78 mAD | AAAACACCTAAAATTAAGCAAAGTATTTTCGATCATAAAATTATGTTAAGCAAAGAATTA (SEQ ID NO: 1159) | 6 |
| 79 sAD | ACTTTTGTGATTTTATGATTTGTAATTGTCGAGTATATAGAGGGACATCAGTATTCTTAC (SEQ ID NO: 1160) | 1 |
| 80 sAD | AAGCAAACAATGAAATTGAAGGGAAATATCGAGATTTTAATAGGAATTGCACTGAATCTA (SEQ ID NO: 1161) | 12 |
| 81 mAD | CACAATGATGCTCACCGTCGTGTGAGCTTCGACCCTAGTTCCTGACACGTAAATATTTGA (SEQ ID NO: 1162) | 14 |
| 82 sAD | TAAAAATGATTTTCAAGACGTGGAAAATTCGATTTTAATGAACAGTATCAAGTGCAAAAA (SEQ ID NO: 1163) | 15 |

TABLE 2.a6

| | Probe Location | | | | 4 kb Sequence Location | | | | |
|---|---|---|---|---|---|---|---|---|---|
| | Start1 | End1 | Start2 | End2 | Chr | Start1 | End1 | Start2 | End2 |
| 1 | 68414192 | 68414223 | 68469116 | 68469147 | 16 | 68414192 | 68418193 | 68465146 | 68469147 |
| 2 | 107580951 | 107580982 | 107700114 | 107700145 | 7 | 107580951 | 107584952 | 107696144 | 107700145 |
| 3 | 28475847 | 28475878 | 28536205 | 28536236 | 8 | 28471877 | 28475878 | 28536205 | 28540206 |
| 4 | 177039010 | 177039041 | 177111170 | 177111201 | 1 | 177039010 | 177043011 | 177107200 | 177111201 |
| 5 | 186757832 | 186757863 | 186806428 | 186806459 | 1 | 186753862 | 186757863 | 186806428 | 186810429 |
| 6 | 5855640 | 5855671 | 5995131 | 5995162 | 16 | 5855640 | 5859641 | 5995131 | 5999132 |
| 7 | 160421609 | 160421640 | 160495263 | 160495294 | 5 | 160417639 | 160421640 | 160491293 | 160495294 |
| 8 | 154298459 | 154298490 | 154323035 | 154323066 | 6 | 154294489 | 154298490 | 154323035 | 154327036 |
| 9 | 106998395 | 106998426 | 107064399 | 107064430 | 7 | 106998395 | 107002396 | 107064399 | 107068400 |
| 10 | 77410773 | 77410804 | 77438815 | 77438846 | 1 | 77406803 | 77410804 | 77438815 | 77442816 |
| 11 | 20457877 | 20457908 | 20490253 | 20490284 | 2 | 20453907 | 20457908 | 20490253 | 20494254 |
| 12 | 152172707 | 152172738 | 152191742 | 152191773 | 4 | 152168737 | 152172738 | 152191742 | 152195743 |
| 13 | 9784898 | 9784929 | 9821954 | 9821985 | 11 | 9780928 | 9784929 | 9817984 | 9821985 |
| 14 | 27949757 | 27949788 | 28009218 | 28009249 | 21 | 27949757 | 27953758 | 28009218 | 28013219 |
| 15 | 58202022 | 58202053 | 58217905 | 58217936 | 18 | 58202022 | 58206023 | 58213935 | 58217936 |
| 16 | 39224581 | 39224612 | 39309663 | 39309694 | X | 39224581 | 39228582 | 39305693 | 39309694 |
| 17 | 38594689 | 38594720 | 38633652 | 38633683 | 7 | 38594689 | 38598690 | 38633652 | 38637653 |
| 18 | 33554299 | 33554330 | 33595213 | 33595244 | 11 | 33554299 | 33558300 | 33591243 | 33595244 |
| 19 | 76403646 | 76403677 | 76489182 | 76489213 | 10 | 76403646 | 76407647 | 76489182 | 76493183 |
| 20 | 69150186 | 69150217 | 69232095 | 69232126 | 16 | 69146216 | 69150217 | 69228125 | 69232126 |
| 21 | 5037436 | 5037467 | 5050686 | 5050717 | 18 | 5033466 | 5037467 | 5050686 | 5054687 |
| 22 | 36707726 | 36707757 | 36755709 | 36755740 | 22 | 36707726 | 36711727 | 36755709 | 36759710 |
| 23 | 25790070 | 25790101 | 25834224 | 25834255 | 14 | 25790070 | 25794071 | 25830254 | 25834255 |
| 24 | 34433098 | 34433129 | 34463898 | 34463929 | 13 | 34429128 | 34433129 | 34463898 | 34467899 |
| 25 | 76272094 | 76272125 | 76322396 | 76322427 | 17 | 76272094 | 76276095 | 76318426 | 76322427 |
| 26 | 171158407 | 171158438 | 171211504 | 171211535 | 3 | 171158407 | 171162408 | 171207534 | 171211535 |
| 27 | 59259334 | 59259365 | 59282114 | 59282145 | 15 | 59259334 | 59263335 | 59278144 | 59282145 |
| 28 | 157440866 | 157440897 | 157477057 | 157477088 | 5 | 157440866 | 157444867 | 157477057 | 157481058 |
| 29 | 28294415 | 28294446 | 28339600 | 28339631 | 9 | 28290445 | 28294446 | 28335630 | 28339631 |
| 30 | 11308524 | 11308555 | 11365358 | 11365389 | X | 11308524 | 11312525 | 11361388 | 11365389 |
| 31 | 11071108 | 11071139 | 11126627 | 11126658 | 18 | 11071108 | 11075109 | 11122657 | 11126658 |
| 32 | 76419786 | 76419817 | 76444465 | 76444496 | 10 | 76415816 | 76419817 | 76444465 | 76448466 |
| 33 | 46807202 | 46807233 | 46839239 | 46839270 | 3 | 46807202 | 46811203 | 46835269 | 46839270 |
| 34 | 110486946 | 110486977 | 110506292 | 110506323 | 11 | 110486946 | 110490947 | 110506292 | 110510293 |
| 35 | 152326283 | 152326314 | 152437463 | 152437494 | 3 | 152326283 | 152330284 | 152437463 | 152441464 |
| 36 | 182185817 | 182185848 | 182234332 | 182234363 | 3 | 182181847 | 182185848 | 182234332 | 182238333 |
| 37 | 68461134 | 68461165 | 68476885 | 68476916 | 5 | 68461134 | 68465135 | 68476885 | 68480886 |

TABLE 2.a6-continued

| | Probe Location | | | | 4 kb Sequence Location | | | |
|---|---|---|---|---|---|---|---|---|---|
| | Start1 | End1 | Start2 | End2 | Chr | Start1 | End1 | Start2 | End2 |
| 38 | 7483303 | 7483334 | 7542352 | 7542383 | 5 | 7483303 | 7487304 | 7538382 | 7542383 |
| 39 | 80752654 | 80752685 | 80777715 | 80777746 | 15 | 80748684 | 80752685 | 80777715 | 80781716 |
| 40 | 66470757 | 66470788 | 66494159 | 66494190 | 2 | 66470757 | 66474758 | 66490189 | 66494190 |
| 41 | 28270698 | 28270729 | 28339600 | 28339631 | 9 | 28270698 | 28274699 | 28335630 | 28339631 |
| 42 | 10377744 | 10377775 | 10449158 | 10449189 | 12 | 10377744 | 10381745 | 10445188 | 10449189 |
| 43 | 59884617 | 59884648 | 59950076 | 59950107 | 16 | 59884617 | 59888618 | 59946106 | 59950107 |
| 44 | 117667901 | 117667932 | 117692654 | 117692685 | 1 | 117663931 | 117667932 | 117692654 | 117696655 |
| 45 | 13894526 | 13894557 | 13952953 | 13952984 | 1 | 13894526 | 13898527 | 13948983 | 13952984 |
| 46 | 10158041 | 10158072 | 10186674 | 10186705 | 12 | 10154071 | 10158072 | 10186674 | 10190675 |
| 47 | 13278250 | 13278281 | 13314398 | 13314429 | 12 | 13274280 | 13278281 | 13314398 | 13318399 |
| 48 | 110945253 | 110945284 | 110990865 | 110990896 | 13 | 110945253 | 110949254 | 110986895 | 110990896 |
| 49 | 3861153 | 3861184 | 3884368 | 3884399 | 18 | 3861153 | 3865154 | 3880398 | 3884399 |
| 50 | 104860979 | 104861010 | 104879992 | 104880023 | 2 | 104860979 | 104864980 | 104879992 | 104883993 |
| 51 | 16015948 | 16015979 | 16048422 | 16048453 | 2 | 16011978 | 16015979 | 16048422 | 16052423 |
| 52 | 112303495 | 112303526 | 112315696 | 112315727 | 4 | 112299525 | 112303526 | 112315696 | 112319697 |
| 53 | 137232223 | 137232254 | 137362789 | 137362820 | 6 | 137232223 | 137236224 | 137362789 | 137366790 |
| 54 | 181484002 | 181484033 | 181512003 | 181512034 | 1 | 181484002 | 181488003 | 181508033 | 181512034 |
| 55 | 11226037 | 11226068 | 11269663 | 11269694 | 1 | 11226037 | 11230038 | 11269663 | 11273664 |
| 56 | 45973750 | 45973781 | 46036637 | 46036668 | 11 | 45973750 | 45977751 | 46032667 | 46036668 |
| 57 | 103373638 | 103373669 | 103453557 | 103453588 | 1 | 103373638 | 103377639 | 103449587 | 103453588 |
| 58 | 22970139 | 22970170 | 23003950 | 23003981 | 4 | 22970139 | 22974140 | 22999980 | 23003981 |
| 59 | 30988071 | 30988102 | 31002238 | 31002269 | 21 | 30984101 | 30988102 | 30998268 | 31002269 |
| 60 | 46952555 | 46952586 | 47025687 | 47025718 | 12 | 46952555 | 46956556 | 47021717 | 47025718 |
| 61 | 36109952 | 36109983 | 36164938 | 36164969 | 5 | 36109952 | 36113953 | 36160968 | 36164969 |
| 62 | 65573794 | 65573825 | 65614349 | 65614380 | 15 | 65573794 | 65577795 | 65610379 | 65614380 |
| 63 | 87446096 | 87446127 | 87564889 | 87564920 | 2 | 87446096 | 87450097 | 87560919 | 87564920 |
| 64 | 193193927 | 193193958 | 193232024 | 193232055 | 3 | 193189957 | 193193958 | 193232024 | 193236025 |
| 65 | 121382485 | 121382516 | 121425811 | 121425842 | 2 | 121378515 | 121382516 | 121421841 | 121425842 |
| 66 | 80184350 | 80184381 | 80271930 | 80271961 | 10 | 80184350 | 80188351 | 80267960 | 80271961 |
| 67 | 154154477 | 154154508 | 154202548 | 154202579 | 6 | 154154477 | 154158478 | 154202548 | 154206549 |
| 68 | 169107708 | 169107739 | 169149123 | 169149154 | 3 | 169107708 | 169111709 | 169149123 | 169153124 |
| 69 | 77410773 | 77410804 | 77425166 | 77425197 | 1 | 77406803 | 77410804 | 77425166 | 77429167 |
| 70 | 21323380 | 21323411 | 21387147 | 21387178 | 2 | 21319410 | 21323411 | 21383177 | 21387178 |
| 71 | 146070956 | 146070987 | 146155392 | 146155423 | 6 | 146066986 | 146070987 | 146155392 | 146159393 |
| 72 | 96189131 | 96189162 | 96253608 | 96253639 | 7 | 96185161 | 96189162 | 96249638 | 96253639 |
| 73 | 227875567 | 227875598 | 227932093 | 227932124 | 2 | 227875567 | 227879568 | 227928123 | 227932124 |
| 74 | 16444934 | 16444965 | 16551800 | 16551831 | 3 | 16440964 | 16444965 | 16547830 | 16551831 |
| 75 | 8818963 | 8818994 | 8830500 | 8830531 | 9 | 8814993 | 8818994 | 8830500 | 8834501 |
| 76 | 30947497 | 30947528 | 30988071 | 30988102 | 21 | 30947497 | 30951498 | 30984101 | 30988102 |
| 77 | 229797491 | 229797522 | 229855687 | 229855718 | 1 | 229793521 | 229797522 | 229851717 | 229855718 |
| 78 | 149231681 | 149231712 | 149287970 | 149288001 | 6 | 149227711 | 149231712 | 149287970 | 149291971 |
| 79 | 65277406 | 65277437 | 65337853 | 65337884 | 1 | 65273436 | 65277437 | 65337853 | 65341854 |
| 80 | 98976985 | 98977016 | 99003375 | 99003406 | 12 | 98973015 | 98977016 | 99003375 | 99007376 |
| 81 | 90618462 | 90618493 | 90720884 | 90720915 | 14 | 90614492 | 90618493 | 90720884 | 90724885 |
| 82 | 33935218 | 33935249 | 33988276 | 33988307 | 15 | 33931248 | 33935249 | 33988276 | 33992277 |

TABLE 2.a7

| | Probe | PCR-Primer1_ID | PCR_Primer1 |
|---|---|---|---|
| 1 | ORF1_16_68414192_68421728_68462182_68469147_RF | OBD159_705 | TGGAGAGGTGGAGGGAGGTAGGA (SEQ ID NO: 1164) |
| 2 | ORF1_7_107580951_107585747_107694264_107700145_RF | OBD159_709 | CAACTGTGACTTGACTCCTTGCTAAG (SEQ ID NO: 1165) |
| 3 | ORF1_8_28471461_28475878_28536205_28541536_FR | OBD159_713 | ATTGACTAACAACAACAAGAAAGC (SEQ ID NO: 1166) |
| 4 | ORF10_1_177039010_177043486_177103748_177111201_RF | OBD159_717 | GCCCCTCTTCTTTGCCAAGCACT (SEQ ID NO: 1167) |
| 5 | ORF10_1_186754095_186757863_186806428_186824334_FR | OBD159_721 | ACAAGAGATGCTCCACAATACATTTG (SEQ ID NO: 1168) |
| 6 | ORF10_16_5855640_5863059_5995131_5999657_RR | OBD159_725 | GAAAGTAATCTTATTGACGATAGC (SEQ ID NO: 1169) |
| 7 | ORF10_5_160420118_160421640_160489817_160495294_FF | OBD159_729 | GCATAAGAGAATGACTCAAACGCTGC (SEQ ID NO: 1170) |
| 8 | ORF10_6_154294994_154298490_154323035_154324807_FR | OBD159_733 | TCCCAAGTGGTCCCCAAAATGTCTTT |

TABLE 2.a7-continued

| Probe | PCR-Primer1_ID | PCR_Primer1 |
|---|---|---|
| | | (SEQ ID NO: 1171) |
| 9 ORF10_7_106998395_107001277_107064399_107071524_RR | OBD159_737 | GGGACAGTGTGGTCTCCAGAATC (SEQ ID NO: 1172) |
| 10 ORF100_1_77409324_77410804_77438815_77446913_FR | OBD159_741 | AAGTCAGAAAGCCACAAGATAAAT (SEQ ID NO: 1173) |
| 11 ORF101_2_20454246_20457908_20490253_20493006_FR | OBD159_745 | GCCCTCTACTGCCTCAGGTTCTT (SEQ ID NO: 1174) |
| 12 ORF101_4_152168385_152172738_152191742_152196830_FR | OBD159_749 | CACATAGTTGCTTCTCTTCAAGGTGT (SEQ ID NO: 1175) |
| 13 ORF102_11_9783875_9784929_9820736_9821985_FF | OBD159_753 | GCAGACAGGAGATAAGAGCCATCAGG (SEQ ID NO: 1176) |
| 14 ORF102_21_27949757_27955906_28009218_28020470_RR | OBD159_757 | CCAGTGAGCATAAACAACCCTCT (SEQ ID NO: 1177) |
| 15 ORF103_18_58202022_58205094_58215328_58217936_RF | OBD159_761 | TGTAGAGCCAAATAGCCACAGGGATA (SEQ ID NO: 966) |
| 16 ORF106_X_39224581_39226649_39303922_39309694_RF | OBD159_765 | TGAAAGAAAGAGGTTGTCAAGAAT (SEQ ID NO: 1179) |
| 17 ORF107_7_38594689_38595956_38633652_38638705_RR | OBD159_769 | ATGTCTTTATCTTGCTTCCTTTAGGG (SEQ ID NO: 1180) |
| 18 ORF108_11_33554299_33557937_33584612_33595244_RF | OBD159_773 | GAATAAGCACTTCTTCTTGGATTAGC (SEQ ID NO: 472) |
| 19 ORF11_10_76403646_76410014_76489182_76492128_RR | OBD159_777 | ACAAAATAGAACCCTGGTCCCACC (SEQ ID NO: 1182) |
| 20 ORF11_16_69148710_69150217_69228303_69232126_FF | OBD159_781 | TGCCTGGCTGATGTTTCTTGGATA (SEQ ID NO: 1183) |
| 21 ORF11_18_5035567_5037467_5050686_5056562_FR | OBD159_785 | GCATCATTTGAAACCTTGGTGGCTGC (SEQ ID NO: 1184) |
| 22 ORF11_22_36707726_36712518_36755709_36758053_RR | OBD159_789 | GTTGAGTTTGGTCTCCCTGCCCC (SEQ ID NO: 1185) |
| 23 ORF110_14_25790070_25797847_25830955_25834255_RF | OBD159_793 | CCTTAGAGCCAATCATTACAGCGTTC (SEQ ID NO: 1186) |
| 24 ORF111_13_34426191_34433129_34463898_34472100_FR | OBD159_797 | CACAGTGGGCTCAGTGTCAACAAACC (SEQ ID NO: 1187) |
| 25 ORF111_17_76272094_76274120_76321002_76322427_RF | OBD159_801 | GACAGAGCAAGACTCCATCTCAA (SEQ ID NO: 1188) |
| 26 ORF114_3_171158407_171161714_171201848_171211535_RF | OBD159_805 | CAGCAAACTGGCATAGCACAATCTC (SEQ ID NO: 1189) |
| 27 ORF115_15_59259334_59261999_59275124_59282145_RF | OBD159_809 | CACACTGGCATTCCCTATTGGGC (SEQ ID NO: 1190) |
| 28 ORF115_5_157440866_157447858_157477057_157480958_RR | OBD159_813 | CTGAATGGTGTGTCGCAGAGCAG (SEQ ID NO: 1191) |
| 29 ORF115_9_28293258_28294446_28333777_28339631_FF | OBD159_817 | GACATAGAATAATCTCCATCCATTGC (SEQ ID NO: 1192) |
| 30 ORF115_X_11308524_11309949_11364232_11365389_RF | OBD159_821 | AGCCAACAATACACAGAGCAGGACAG (SEQ ID NO: 1193) |
| 31 ORF118_18_11071108_11073538_11120542_11126658_RF | OBD159_825 | CCTCACACAGTCCTCTTCCCACC (SEQ ID NO: 1194) |
| 32 ORF12_10_76413183_76419817_76444465_76451876_FR | OBD159_829 | CCACCAGCAGTTATTGAGCATTCCTT (SEQ ID NO: 1195) |
| 33 ORF12_3_46807202_46811416_46833087_46839270_RF | OBD159_833 | CCAGCAAAAGGCAGGAATCAGTGC (SEQ ID NO: 1196) |

TABLE 2.a7-continued

| | Probe | PCR-Primer1_ID | PCR_Primer1 |
|---|---|---|---|
| 34 | ORF120_11_110486946_110488037_110506292_110507507_RF | OBD159_837 | CCTGTCAGTGGTGGGTAGGAGGG (SEQ ID NO: 1197) |
| 35 | ORF121_3_152326283_152334449_152437463_152442012_RR | OBD159_841 | CTTGATAATAAACGCAGCAGAAAT (SEQ ID NO: 1198) |
| 36 | ORF121_3_182183246_182185848_182234332_182242013_FR | OBD159_845 | GAGACTGAGGTTGCTTCCAATGTTCC (SEQ ID NO: 1199) |
| 37 | ORF121_5_68461134_68466125_68476885_68484945_RR | OBD159_849 | CAGTGGTAATCTATGGGTGGTAGGA A (SEQ ID NO: 1200) |
| 38 | ORF122_5_7483303_7486792_7540900_7542383_RF | OBD159_853 | TTTGTCACAGGGTCCATAACTGGGTT (SEQ ID NO: 1201) |
| 39 | ORF123_15_80750227_80752685_80777715_80785550_FR | OBD159_857 | GGTCATTCCTCTCTCACTGTGTTTCA (SEQ ID NO: 1202) |
| 40 | ORF124_2_66470757_66475654_66492459_66494190_RF | OBD159_861 | CTCAAAGTTGTTCTCAGCCTTCTCAC (SEQ ID NO: 1203) |
| 41 | ORF125_9_28270698_28275294_28333777_28339631_RF | OBD159_865 | GCCTAAGTCCAGTAGTATGGTGGCTG (SEQ ID NO: 1204) |
| 42 | ORF127_12_10377744_10380286_10447112_10449189_RF | OBD159_869 | ATGTATTGTGGATTGAAAGCATTT (SEQ ID NO: 1205) |
| 43 | ORF127_16_59884617_59887309_59942777_59950107_RF | OBD159_873 | CTTGGTGAAAGGGAGTGAATCTCTGC (SEQ ID NO: 1206) |
| 44 | ORF13_1_117665372_117667932_117692654_117695846_FR | OBD159_877 | CTCCTCCCAACTTCTACTCACCCC (SEQ ID NO: 1207) |
| 45 | ORF13_1_13894526_13898185_13945271_13952984_RF | OBD159_881 | GTGCTGTGTGACCTTGGGATGTCC (SEQ ID NO: 1208) |
| 46 | ORF13_12_10157054_10158072_10186674_10187896_FR | OBD159_885 | CCTGAGCAACAAGAGCGAAACTC (SEQ ID NO: 1209) |
| 47 | ORF13_12_13275230_13278281_13314398_13317948_FR | OBD159_889 | TCATTCTCCACCTCCCACCCTGC (SEQ ID NO: 1210) |
| 48 | ORF13_13_110945253_110947067_110985607_110990896_RF | OBD159_893 | GCTGAAGCAGTGTGGCAACAGGA (SEQ ID NO: 1211) |
| 49 | ORF13_18_3861153_3868188_3881709_3884399_RF_00 | OBD159_897 | CTCTCTCTACAAATCAGGTTCCACTG (SEQ ID NO: 1212) |
| 50 | ORF13_2_104860979_104864045_104879992_104882471_RR | OBD159_901 | CCTGGAACTTGGGCAAACTAAACTCC (SEQ ID NO: 1213) |
| 51 | ORF13_2_16010255_16015979_16048422_16049999_FR | OBD159_905 | GGATGGTAGTTTCCACCGTCTGG (SEQ ID NO: 1214) |
| 52 | ORF13_4_112301960_112303526_112315696_112317586_FR | OBD159_909 | GATTCATCATTTACTGCCTCCACCAG (SEQ ID NO: 1215) |
| 53 | ORF13_6_137232223_137235679_137362789_137365756_RR | OBD159_913 | GGTCATCATCGTGGACAAGGAAAGC C (SEQ ID NO: 1216) |
| 54 | ORF130_1_181484002_181486199_181499646_181512034_RF | OBD159_917 | GCGTTGGAGAAGACCTCAGCCAT (SEQ ID NO: 1217) |
| 55 | ORF131_1_11226037_11228251_11269663_11271072_RR | OBD159_921 | GTGTTAAATATGTTGAAT (SEQ ID NO: 1218) |
| 56 | ORF132_11_45973750_45978097_46033363_46036668_RF | OBD159_925 | GCTACATCTGGGTGAACTTTAGACTC (SEQ ID NO: 1219) |
| 57 | ORF133_1_103373638_103377704_103450404_103453588_RF | OBD159_929 | GTGTTCATTACCTGATTTGATTTA (SEQ ID NO: 1220) |
| 58 | ORF134_4_22970139_22978081_22994756_23003981_RF | OBD159_933 | GGGTGCTACGAGATAGGGAAAGGAT G (SEQ ID NO: 1221) |
| 59 | ORF135_21_30984126_30988102_30998437_31002269_FF | OBD159_937 | TGGGTTGACTAAAATCCCGTAAAAGC (SEQ ID NO: 1222) |

TABLE 2.a7-continued

| Probe | PCR-Primer1_ID | PCR_Primer1 |
|---|---|---|
| 60 ORF137_12_46952555_46954006_47024050_47025718_RF | OBD159_941 | CCTGTGCCCAGTCTCCGTCTTTTATC (SEQ ID NO: 1223) |
| 61 ORF137_5_36109952_36117110_36160830_36164969_RF | OBD159_945 | TTCACTTACCCTCACCGCACTCAACC (SEQ ID NO: 1224) |
| 62 ORF138_15_65573794_65596385_65611369_65614380_RF | OBD159_949 | TCACCCAGTTTCTGCTGTCAATGC (SEQ ID NO: 1225) |
| 63 ORF138_2_87446096_87451261_87563076_87564920_RF | OBD159_953 | AATGAACTATCAGGCTATGTAAAA (SEQ ID NO: 1226) |
| 64 ORF138_3_193187039_193193958_193232024_193235318_FR | OBD159_957 | GACAGCAGGACACCTCAGTGCCATAA (SEQ ID NO: 1227) |
| 65 ORF139_2_121377681_121382516_121420995_121425842_FF | OBD159_961 | TTAGTCTCTTCTTTCCTTGACAAA (SEQ ID NO: 1228) |
| 66 ORF14_10_80184350_80188816_80268946_80271961_RF | OBD159_965 | GCATAGGGTAGTTGCTCCTTGAGTTT (SEQ ID NO: 1229) |
| 67 ORF14_6_154154477_154163186_154202548_154212736_RR | OBD159_969 | CCTCTGGTGGCAGTCATCAAAATCGC (SEQ ID NO: 1230) |
| 68 ORF140_3_169107708_169110909_169149123_169152499_RR | OBD159_973 | TATGGTTCCAGCAGATAGTTTCCCTG (SEQ ID NO: 1231) |
| 69 ORF141_1_77409324_77410804_77425166_77437348_FR | OBD159_977 | AAGTCAGAAAGCCACAAGATAAAT (SEQ ID NO: 1173) |
| 70 ORF143_2_21321954_21323411_21382106_21387178_FF | OBD159_981 | CAATCTTGTGGTATCCTATGTCTTAG (SEQ ID NO: 1233) |
| 71 ORF143_6_146066540_146070987_146155392_146161780_FR | OBD159_985 | GGCTAAACCCACACCCTGTAATAACC (SEQ ID NO: 1234) |
| 72 ORF143_7_96186525_96189162_96249981_96253639_FF | OBD159_989 | GTGACACCAACACGGGATTCTTTCGC (SEQ ID NO: 1235) |
| 73 ORF144_2_227875567_227878014_227923203_227932124_RF | OBD159_993 | CTTCTTCTCCTTGCCTTTCCTCTGGA (SEQ ID NO: 1236) |
| 74 ORF144_3_16438382_16444965_16548225_16551831_FF | OBD159_997 | CCACTACAACCACCATCACTCGCTGT (SEQ ID NO: 1237) |
| 75 ORF146_9_8811961_8818994_8830500_8836449_FR | OBD159_1001 | AACTAACCAGGAAAACGACATAGCAC (SEQ ID NO: 1238) |
| 76 ORF147_21_30947497_30949256_30984126_30988102_RF | OBD159_1005 | GCATTCCAGGTCCAAGATGTCCT (SEQ ID NO: 1239) |
| 77 ORF148_1_229796281_229797522_229849427_229855718_FF | OBD159_1009 | CACAGCAACAAAAGCAACCTGGTGTC (SEQ ID NO: 1240) |
| 78 ORF149_6_149229853_149231712_149287970_149291658_FR | OBD159_1013 | ATTGACTGTCTTGGGAAAAGCACTTA (SEQ ID NO: 1241) |
| 79 ORF15_1_65274536_65277437_65337853_65339914_FR | OBD159_1017 | TTCTGAGTCTGGTTCTCCATTCAAAT (SEQ ID NO: 1242) |
| 80 ORF15_12_98974145_98977016_99003375_99005607_FR | OBD159_1021 | CAGTGGCTCCAAAGTCAAAACAAGGT (SEQ ID NO: 1243) |
| 81 ORF15_14_90615204_90618493_90720884_90724855_FR | OBD159_1025 | AACTCCTGGCTCAAGGTGTTGCTTTG (SEQ ID NO: 1244) |
| 82 ORF15_15_33922077_33935249_33988276_33992735_FR | OBD159_1029 | GGCTCCACTTTCTCCTATTTTGAACC (SEQ ID NO: 1245) |

TABLE 2.a8

| | PCR-Primer2_ID | PCR_Primer2 | Marker | GLMNET |
|---|---|---|---|---|
| 1 | OBD159_707 | TGTCCTCCCTTCTCTTGCTCAGC (SEQ ID NO: 1246) | OBD159_705_707 | 0.000204132 |
| 2 | OBD159_711 | CTGAGACAAGGCAGGGCAGGTGTTA (SEQ ID NO: 1247) | OBD159_709_711 | 0.003791936 |
| 3 | OBD159_715 | TTAGATGGATGAAAGAGATGAAAA (SEQ ID NO: 1248) | OBD159_713_715 | 0.000729495 |
| 4 | OBD159_719 | GCCAAGGGTTCAGAAAGCCCAGG (SEQ ID NO: 1249) | OBD159_717_719 | 0.00147384 |
| 5 | OBD159_723 | CACCAGCCTTTGTGTTGTCGTCCAAT (SEQ ID NO: 1250) | OBD159_721_723 | 0.000488261 |
| 6 | OBD159_727 | ACGCAAATGCTTTCCCACAGAATA (SEQ ID NO: 1251) | OBD159_725_727 | 0.001276989 |
| 7 | OBD159_731 | CCGCATCAGAGATTCCTCAAGTTTGC (SEQ ID NO: 1252) | OBD159_729_731 | 0.004266748 |
| 8 | OBD159_735 | GGGCAGGGTATCTAAGGCAATGGTTC (SEQ ID NO: 1253) | OBD159_733_735 | 0.001897525 |
| 9 | OBD159_739 | GAAGCCAGCACTTGGGAGACCAC (SEQ ID NO: 1254) | OBD159_737_739 | 0.000703029 |
| 10 | OBD159_743 | TTCTGACTCTCTCCCTTTGGTGAG (SEQ ID NO: 1255) | OBD159_741_743 | 0.001438401 |
| 11 | OBD159_747 | TCCGACCAACCCAGACCAACCTG (SEQ ID NO: 1256) | OBD159_745_747 | 0.002378528 |
| 12 | OBD159_751 | ATGGTGGTAAACACAGACATCTATCT (SEQ ID NO: 1257) | OBD159_749_751 | 0.00037646 |
| 13 | OBD159_755 | GGCTTGGGAAATCACTCTAATAGGTC (SEQ ID NO: 1258) | OBD159_753_755 | 0.002320932 |
| 14 | OBD159_759 | CAAATCTCTCATCTACGCCGTTTCTA (SEQ ID NO: 1259) | OBD159_757_759 | 0.000257549 |
| 15 | OBD159_763 | TTGAGGCAGGAAGAAAGGTTTATGGC (SEQ ID NO: 1260) | OBD159_761_763 | -0.000201451 |
| 16 | OBD159_767 | TTTTCTGCCTCAGCCTCCCAAGTA (SEQ ID NO: 1261) | OBD159_765_767 | -0.000807931 |
| 17 | OBD159_771 | AGAGCCAGTCCGAGTTCCAAAAC (SEQ ID NO: 1262) | OBD159_769_771 | 0.001416613 |
| 18 | OBD159_775 | AGATTCTGTCCCTGGCAACCAAACAC (SEQ ID NO: 1263) | OBD159_773_775 | 0.000108683 |
| 19 | OBD159_779 | GGAAAATCTAAAAGTAATGGACAAA (SEQ ID NO: 1264) | OBD159_777_779 | -0.000946523 |
| 20 | OBD159_783 | CTTGCTTGTTATTCTACATTTCTAT (SEQ ID NO: 1265) | OBD159_781_783 | 0.000634476 |
| 21 | OBD159_787 | ATTCGGAGTTGAGAGTCCTGGGTCTT (SEQ ID NO: 1266) | OBD159_785_787 | 0.001606518 |
| 22 | OBD159_791 | CTCCCCACCCTTCTGGAAAAGAG (SEQ ID NO: 1267) | OBD159_789_791 | 0.000708309 |
| 23 | OBD159_795 | GGTTGGAAGCCTTACGCAGTCTCAAG (SEQ ID NO: 1268) | OBD159_793_795 | 0.001129047 |
| 24 | OBD159_799 | CTCTCTTGGTGTTTGGAAATCTGTGC (SEQ ID NO: 1269) | OBD159_797_799 | 0.001893287 |
| 25 | OBD159_803 | AAAACTGAAAGGACGAACCCAGC (SEQ ID NO: 1270) | OBD159_801_803 | 0.001392556 |
| 26 | OBD159_807 | CAGCCCAGGACCACCAGCGAAGT (SEQ ID NO: 1271) | OBD159_805_807 | 0.001267325 |

TABLE 2.a8-continued

| | PCR-Primer2_ID | PCR_Primer2 | Marker | GLMNET |
|---|---|---|---|---|
| 27 | OBD159_811 | GACCAGACCAAACCAAACCAACAT (SEQ ID NO: 1272) | OBD159_809_811 | -0.00013287 |
| 28 | OBD159_815 | GACCCTGAGCCACAGCAAAGCCT (SEQ ID NO: 1273) | OBD159_813_815 | 0.002957875 |
| 29 | OBD159_819 | CTAAGTCCAGTAGTATGGTGGCTGTG (SEQ ID NO: 1274) | OBD159_817_819 | 0.000983784 |
| 30 | OBD159_823 | GCTATGGAGTGTCTCTTTGGGTCTCA (SEQ ID NO: 1275) | OBD159_821_823 | 0.000764481 |
| 31 | OBD159_827 | GCCTGTCACTCCAATCTGTGGTG (SEQ ID NO: 1276) | OBD159_825_827 | 0.000329008 |
| 32 | OBD159_831 | AGGCTGTGCTTGGCTGGTTGTGTAAC (SEQ ID NO: 1277) | OBD159_829_831 | 0 |
| 33 | OBD159_835 | GGAAAGTCCCAGGCTCCAGGAAG (SEQ ID NO: 1278) | OBD159_833_835 | 0.002689289 |
| 34 | OBD159_839 | GTCCCTGCTCTCAAAGAACTTAGGA (SEQ ID NO: 1279) | OBD159_8379_839 | 0.000789295 |
| 35 | OBD159_843 | CTGGAAGTGACCTTAGAGATTATC (SEQ ID NO: 1280) | OBD159_841_843 | 0.001532591 |
| 36 | OBD159_847 | TCCTCAGATGATGTTTCGGCATTTGC (SEQ ID NO: 1281) | OBD159_845_847 | 0 |
| 37 | OBD159_851 | GGTGACTGACAGCCAAATCCAATGGG (SEQ ID NO: 1282) | OBD159_849_851 | -0.001073064 |
| 38 | OBD159_855 | TGGGCTCCAAACACCCGAGGTCAT (SEQ ID NO: 1283) | OBD159_8539_855 | 0 |
| 39 | OBD159_859 | CTCCCAGAAACCAGACCCACAAAGAG (SEQ ID NO: 1284) | OBD159_857_859 | 0.001183739 |
| 40 | OBD159_863 | ATCAAGAAAACTACTCACAGGACAGC (SEQ ID NO: 1285) | OBD159_861_863 | 0.001815264 |
| 41 | OBD159_867 | CAAGTCCTCATCTGTAGAGTCTGGAT (SEQ ID NO: 1286) | OBD159_865_867 | 0.00089186 |
| 42 | OBD159_871 | AAAGAGACAGAAACAGAGAGGTTA (SEQ ID NO: 1287) | OBD159_869_871 | 0.00057281 |
| 43 | OBD159_875 | GCAGCCATTACAAAATCACCTTCAGG (SEQ ID NO: 1288) | OBD159_873_875 | 0.001794869 |
| 44 | OBD159_879 | GCCAGGAAAAGCCTCAGAGTCAC (SEQ ID NO: 1289) | OBD159_877_879 | 0.002480365 |
| 45 | OBD159_883 | GTGCTCGTCTCACCATCTTCCTG (SEQ ID NO: 1290) | OBD159_881_883 | 0.001698299 |
| 46 | OBD159_887 | CATCAGGCTTCTGGGAATGGAAAT (SEQ ID NO: 1291) | OBD159_885_887 | 0.001560892 |
| 47 | OBD159_891 | AAGACAGGGTTGGCAAAGGCAGC (SEQ ID NO: 1292) | OBD159_889_891 | 0.002874402 |
| 48 | OBD159_895 | TCTCCACTCACTCCCACCCTTGG (SEQ ID NO: 1293) | OBD159_893_895 | 0.00113627 |
| 49 | OBD159_899 | GCTTTCCTTCTTCCTTATGATGACAG (SEQ ID NO: 1294) | OBD159_897_899 | 0.001771069 |
| 50 | OBD159_903 | TTGGATAAGAACGAGCAGGTATTGGC (SEQ ID NO: 1295) | OBD159_901_903 | 0.001898652 |
| 51 | OBD159_907 | GCAAAGACCTACTCCCACCTCCTC (SEQ ID NO: 1296) | OBD159_905_907 | 0.001697095 |
| 52 | OBD159_911 | CCCAAAGTTTCGGTTCATTAGATTTC (SEQ ID NO: 1297) | OBD159_909_911 | 0.001506795 |

TABLE 2.a8-continued

| | PCR-Primer2_ID | PCR_Primer2 | Marker | GLMNET |
|---|---|---|---|---|
| 53 | OBD159_915 | AAGGAGAGGGAAAACAGTGGGCAATA (SEQ ID NO: 1298) | OBD159_913_915 | 0.000946814 |
| 54 | OBD159_919 | AAACGGGTCTCCACGGCACCAAG (SEQ ID NO: 1299) | OBD159_917_919 | 0.003366899 |
| 55 | OBD159_923 | TGGCAGACGCCTGTAATCCCAG (SEQ ID NO: 1300) | OBD159_921_923 | 0.001743503 |
| 56 | OBD159_927 | GATTGAACGCCATCTGGTGTGACTGG (SEQ ID NO: 1301) | OBD159_925_927 | 0.003692609 |
| 57 | OBD159_931 | TCTTATTTCCCAAGGCTCAAAAGC (SEQ ID NO: 1302) | OBD159_929_931 | 8.95E-05 |
| 58 | OBD159_935 | GTGGTTCAAGGTAGGAAGAGAAAAGC (SEQ ID NO: 1303) | OBD159_933_935 | 0.001522281 |
| 59 | OBD159_939 | TAACCAGGGTAGCCTTGATGCCAGC (SEQ ID NO: 464) | OBD159_937_939 | 0.00052172 |
| 60 | OBD159_943 | GCCACACTGGAACATACCAAGTAAAC (SEQ ID NO: 1305) | OBD159_941_943 | 0.002045299 |
| 61 | OBD159_947 | TTGCCCGCTATCTTTACTTCAGTTGC (SEQ ID NO: 1306) | OBD159_945_947 | 0.002404691 |
| 62 | OBD159_951 | ATCAGTGTTTTCTCCTCTCAAATA (SEQ ID NO: 1307) | OBD159_949_951 | 0.000121861 |
| 63 | OBD159_955 | TACAGTATTTGAGTCACAGGCTGC (SEQ ID NO: 1308) | OBD159_953_955 | 0.000910382 |
| 64 | OBD159_959 | ATCACCTCCTATGAAGACCTACCTCT (SEQ ID NO: 1309) | OBD159_957_959 | 0.001773689 |
| 65 | OBD159_963 | GAAAATGAATCCAAGAAAACTCTAT (SEQ ID NO: 1310) | OBD159_961_963 | 0.000145047 |
| 66 | OBD159_967 | ACACGGTCCCTGACTCAAGATGGTTG (SEQ ID NO: 1311) | OBD159_965_967 | 9.34E-06 |
| 67 | OBD159_971 | GCACAAACACGATGACACTTCACAGA (SEQ ID NO: 1312) | OBD159_969_971 | 0.000203749 |
| 68 | OBD159_975 | ACTGTCTGAAGCAATCGGTTCCCCAG (SEQ ID NO: 1313) | OBD159_973_975 | 0.000150605 |
| 69 | OBD159_979 | AAAGTGCTGGGATTACAGGCGTGA (SEQ ID NO: 1314) | OBD159_977_979 | 0.002131125 |
| 70 | OBD159_983 | TTCTGTGGAGGACCTGGGAAATACTC (SEQ ID NO: 282) | OBD159_981_983 | 0.00250562 |
| 71 | OBD159_987 | CTCTAAGTAAATCCTGGTCATTCCCC (SEQ ID NO: 1316) | OBD159_985_987 | 0.000695805 |
| 72 | OBD159_991 | TGTTATCAGGACAGCAGTTAGCAGGA (SEQ ID NO: 1317) | OBD159_989_991 | -0.000234901 |
| 73 | OBD159_995 | GGAGAAAAGACAAACCAGGGAAAGGG (SEQ ID NO: 1318) | OBD159_993_995 | 0 |
| 74 | OBD159_999 | TTTGAAATGGAGACATAGCCCAAGGC (SEQ ID NO: 1319) | OBD159_997_999 | 0.001961012 |
| 75 | OBD159_1003 | CCTTTGCTGGGTATTGACTGGGAGGA (SEQ ID NO: 1320) | OBD159_1001_1003 | 0.001676635 |
| 76 | OBD159_1007 | GTGGTGTGAGTTCAGGAGGGTTTAGG (SEQ ID NO: 1321) | OBD159_1005_1007 | 0.0028322 |
| 77 | OBD159_1011 | CCACCGATTTATTGCCCTGTAGGACA (SEQ ID NO: 1322) | OBD159_1009_1011 | 0.000290704 |
| 78 | OBD159_1015 | GGGACTGAGTGACACAAGGACCATTT (SEQ ID NO: 1323) | OBD159_1013_1015 | 0.001727135 |

TABLE 2.a8-continued

| | PCR-Primer2_ID | PCR_Primer2 | Marker | GLMNET |
|---|---|---|---|---|
| 79 | OBD159_1019 | ATGAGCCTGGAACATCTGGTGATACC (SEQ ID NO: 1324) | OBD159_1017_1019 | 2.92E-05 |
| 80 | OBD159_1023 | GCAGCCAATCTTGAGAACTGATGCCC (SEQ ID NO: 1325) | OBD159_1021_1023 | 0.003000365 |
| 81 | OBD159_1027 | TGGGAGCAGGAGTGGAGGAATAGATT (SEQ ID NO: 1326) | OBD159_1025_1027 | 0.004030392 |
| 82 | OBD159_1031 | GCGGTCATCAGTGCTGTCATTTCCTG (SEQ ID NO: 1327) | OBD159_1029_1031 | 0.00143169 |

TABLE 2.a9

| | Gene |
|---|---|
| 1 | SMPD3; rs2863973 |
| 2 | BCAP29; SLC26A4 |
| 3 | FBXO16; FZD3 |
| 4 | ASTN1 |
| 5 | PLA2G4A; rs4140564 |
| 6 | NA |
| 7 | PTTG1; SLU7 |
| 8 | CNKSR3; IPCEF1; OPRM1 |
| 9 | PRKAR2B |
| 10 | AK5; rs6695572 |
| 11 | RHOB |
| 12 | FBXW7 |
| 13 | SBF2 |
| 14 | NA |
| 15 | NEDD4L; rs17064520 |
| 16 | NA |
| 17 | AMPH; FAM183B |
| 18 | KIAA1549L |
| 19 | C10orf11; rs10509373; rs11593840 |
| 20 | CHTF8; CIRH1A; SNTB2; rs119465999 |
| 21 | C18orf42 |
| 22 | IFT27; rs5750285 |
| 23 | rs12586774; rs862946 |
| 24 | NA |
| 25 | PRPSAP1; QRICH2; UBALD2 |
| 26 | rs886037841; rs9810566; TNIK |
| 27 | MYO1E |
| 28 | ADAM19; NIPAL4; rs1990950; rs199422216; rs199422217; rs370356566; rs375688767; rs775903553 |
| 29 | LINGO2; rs10812774; rs7851437 |
| 30 | AMELX; ARHGAP6 |
| 31 | PIEZO2; rs7228002 |
| 32 | C10orf11 |
| 33 | PRSS42; PRSS45; PRSS50 |
| 34 | ARHGAP20; FDX1 |
| 35 | MBNL1; TMEM14E; rs185894411 |
| 36 | NA |
| 37 | rs113246091; rs11960179 |
| 38 | ADCY2; rs11948030; rs13166360; rs17231202; rs17826395; rs17826816; rs34043481 |
| 39 | ABHD17C; CEMIP; rs11634851 |
| 40 | MEIS1; rs11692361 |
| 41 | LINGO2; rs10812774; rs7357773 |
| 42 | KLRC1; KLRC2; KLRC3; KLRC4; KLRC4-KLRK1; KLRK1; RP11-277P12.6; rs11053781; rs11053802; rs2617167; rs2617170; rs7298732; rs77926410 |
| 43 | NA |
| 44 | NA |
| 45 | rs7542939 |
| 46 | GABARAPL1; OLR1; TMEM52B |
| 47 | EMP1; rs1479119 |
| 48 | ANKRD10 |
| 49 | DLGAP1 |
| 50 | POU3F3; rs1005999 |
| 51 | MYCN |
| 52 | ALPK1; TIFA |
| 53 | IFNGR1; rs13201877 |
| 54 | CACNA1E; rs679931 |
| 55 | MTOR; UBIAD1 |
| 56 | GYLTL1B; PHF21A |

TABLE 2.a9-continued

| | Gene |
|---|---|
| 57 | RNPC3 |
| 58 | rs358231 |
| 59 | KRTAP19-8 |
| 60 | AMIGO2; SLC38A4 |
| 61 | LMBRD2; SKP2 |
| 62 | PTPLAD1; SLC24A1; VWA9; rs11632310; rs12906196; rs4366668; rs6494529; rs7165102; rs7178686 |
| 63 | PLGLB2 |
| 64 | HRASLS |
| 65 | CLASP1; rs62151096 |
| 66 | ANXA11; MAT1A; rs10887710; rs1298908; rs2819941; rs3851059; rs7087728 |
| 67 | CNKSR3; IPCEF1; OPRM1; rs2236256; rs4869818 |
| 68 | MECOM; rs12491785; rs2901381; rs864309724 |
| 69 | AK5 |
| 70 | rs11897825; rs2337901 |
| 71 | GRM1; SHPRH |
| 72 | SLC25A13; rs1060499612; rs746155190; rs763191789; rs80338716; rs80338717; rs80338718; rs80338719; rs80338720; rs879255504 |
| 73 | DAW1; rs113776284; rs7591163 |
| 74 | RFTN1 |
| 75 | PTPRD; rs10120450; rs10120501; rs10121203; rs10758996; rs10815964; rs1434254; rs1836229; rs1975197; rs2053125; rs7048621 |
| 76 | KRTAP19-8; rs8134605 |
| 77 | rs4925506 |
| 78 | TAB2 |
| 79 | DNAJC6; rs2477786 |
| 80 | ANKS1B; rs7960581 |
| 81 | RPS6KA5; TTC7B |
| 82 | AVEN; CHRM5; RYR3; rs661968 |

TABLE 2.b1

| | Probe | GeneLocus |
|---|---|---|
| 83 | ORF15_20_20005082_20006543_20074979_20078974_FR | CFAP61; CRNKL1 A20; RIN2; rs1057519885 |
| 84 | ORF15_22_25694410_25695479_25711627_25712666_FR | ADRBK2 |
| 85 | ORF15_4_152191742_152196830_152216416_152218364_FF | FBXW7 |
| 86 | ORF15_5_39114378_39119150_39147583_39150100_FF | FYB; RICTOR |
| 87 | ORF15_6_168253924_168260809_168288516_168295264_RF | DACT2; rs1473500 |
| 88 | ORF15_X_134208394_134214384_134247371_134250961_FF | CCDC160; PHF6 |
| 89 | ORF150_2_156262877_156267602_156333728_156335220_FR | NR4A2 |
| 90 | ORF151_1_213954211_213958027_214030463_214032351_RF | PROX1 |
| 91 | ORF151_12_30089465_30094558_30144610_30146709_RR | rs11050764; rs4931251 |
| 92 | ORF151_14_25830955_25834255_25934805_25940195_FF | rs12586774; rs862946 |
| 93 | ORF152_12_82605920_82610130_82624217_82631901_FR | METTL25; TMTC2 |
| 94 | ORF152_3_106246431_106249672_106270924_106284204_FR | NA |
| 95 | ORF152_6_115981175_115984851_116082282_116083649_RR | FRK; NT5DC1; rs1933737; rs1999930; rs3822857; rs6909746; rs868943; rs9488822 |
| 96 | ORF155_4_22917017_22918108_22970139_22978081_FR | NA |
| 97 | ORF16_1_76000194_76003911_76083373_76086337_FR | ST6GALNAC3; rs12095069 |
| 98 | ORF16_13_33822756_33828516_33864974_33872117_RR | RFC3 |
| 99 | ORF16_17_4314279_4315337_4363166_4364509_FR | ANKFY1; UBE2G1 |
| 100 | ORF16_2_39607186_39609982_39623225_39627003_FR | MAP4K3; TMEM178A |
| 101 | ORF16_20_46570710_46574158_46631132_46633823_FF | OCSTAMP; SLC13A3; rs847058 |
| 102 | ORF16_22_25569452_25577394_25694410_25695479_RF | ADRBK2; MYO18B |
| 103 | ORF16_22_25661627_25666380_25694410_25695479_RF | ADRBK2 |
| 104 | ORF16_5_39119150_39126856_39147583_39150100_RF | FYB; RICTOR; rs1060505056 |
| 105 | ORF16_6_13526281_13531876_13559103_13561354_RR | GFOD1; SIRT5 |
| 106 | ORF16_6_154154477_154163186_154217494_154220454_RR | CNKSR3; IPCEF1; OPRM1; rs2236256; rs4869818 |
| 107 | ORF161_1_229849427_229855718_229869805_229873008_FF | GALNT2; rs4925506 |
| 108 | ORF161_7_112014904_112016980_112124185_112133295_RR | DOCK4 |
| 109 | ORF162_6_46989661_46997140_47060758_47069708_RF | GPR110; GPR116 |
| 110 | ORF163_3_177780034_177784103_177831413_177834825_FF | NA |
| 111 | ORF166_7_29763050_29768509_29809501_29813015_RR | WIPF3; rs850084 |
| 112 | ORF167_1_229849427_229855718_229908605_229911291_FF | GALNT2; rs4925506 |
| 113 | ORF167_2_195495210_195503375_195555062_195566669_FF | SLC39A10 |
| 114 | ORF168_12_30144610_30146709_30181629_30184999_RR | NA |
| 115 | ORF169_15_95109397_95110442_95161353_95168020_RF | NA |
| 116 | ORF17_12_14122272_14125684_14156567_14160836_FF | GRIN2B |
| 117 | ORF17_2_66361342_66362770_66462513_66470757_FF | MEIS1; rs11692361; rs7596219 |
| 118 | ORF17_20_46568090_46570710_46643075_46649811_FR | SLC13A3 |
| 119 | ORF17_3_64194265_64195323_64225983_64228797_FR | PRICKLE2 |
| 120 | ORF17_4_105415477_105417649_105457783_105460154_FF | PPA2; rs1057517679; rs1057517680; rs138215926; rs139076647; rs146013446; |

TABLE 2.b1-continued

| | Probe | GeneLocus |
|---|---|---|
| | | rs546693824; rs772083375; rs77928427 |
| 121 | ORF17_5_162413257_162414861_162467630_162474185_RF | rs587777363; rs7718928 |
| 122 | ORF17_6_82564978_82571469_82630737_82633712_FR | TPBG; rs1369867 |
| 123 | ORF170_1_58212403_58221374_58250279_58252343_RF | DAB1; rs527409 |
| 124 | ORF170_5_132790667_132795213_132845490_132849804_RF | rs39692; GDF9; SHROOM1; SOWAHA |
| 125 | ORF171_18_11015786_11021011_11118494_11119843_RR | PIEZO2 |
| 126 | ORF172_11_75842855_75846190_75861382_75864724_RF | UVRAG |
| 127 | ORF173_14_39721868_39724679_39792290_39806170_FR | rs148431766; rs17109786 |
| 128 | ORF174_13_110131405_110134324_110153678_110157618_FR | COL4A1; rs11617955; rs641862; rs672601348 |
| 129 | ORF174_2_209659511_209662054_209697743_209702208_FF | MAP2 |
| 130 | ORF175_19_29325557_29328725_29376361_29378170_RR | UQCRFS1; VSTM2B |
| 131 | ORF175_3_69167897_69172562_69218117_69221087_FR | FRMD4B; LMOD3 |
| 132 | ORF18_1_107900199_107901840_107960595_107963096_RR | VAV3; rs2801219; rs345299; rs4915077 |
| 133 | ORF18_1_8397345_8398792_8423193_8424500_RF | RERE; rs301806; rs301807 |
| 134 | ORF18_11_49136317_49141722_49212875_49219818_FR | FOLH1; TRIM64C |
| 135 | ORF18_14_89952946_89954082_89986309_89987695_FF | EFCAB11; TDP1 |
| 136 | ORF18_3_24254159_24259126_24320266_24324992_FF | THRB; rs113700287; rs1158265; rs12485694; rs1505283; rs1505297; rs1505298; rs1505307; rs1868575; rs2167115; rs7610039; rs7610222; rs7622481; rs7640580; rs826230; rs826231; rs826236; rs826238; rs826240; rs862247; rs869784; rs869785; rs9310736; rs9830674 |
| 137 | ORF18_5_88780146_88782265_88885645_88890401_RF | MEF2C; rs1085307051; rs114694170; rs11951031; rs11955542; rs11958689; rs12515983; rs12521522; rs17558256; rs17560407; rs17560451; rs3047819; rs3850651; rs3850653; rs397514655; rs397514656; rs4521516; rs545185248; rs61104616; rs62380364; rs700585; rs797045053; rs869312698; rs876661308 |
| 138 | ORF18_6_137232223_137235679_137341897_137343885_RF | IFNGR1; rs13201877 |
| 139 | ORF180_14_106693397_106698909_106725269_106729795_RF | NA |
| 140 | ORF181_5_148931403_148934917_149013571_149016721_RR | SH3TC2; rs80338933; rs80338934; rs80338935; rs80338936; rs80338937; rs9687065 |
| 141 | ORF183_3_45968082_45972062_46021458_46028558_RF | FYCO1; XCR1 |
| 142 | ORF183_8_52230322_52233827_52319467_52326208_RR | ST18 |
| 143 | ORF186_10_89827266_89829504_89863078_89864649_RR | KIF20B |
| 144 | ORF186_2_198037606_198046520_198099686_198102962_RR | PLCL1 |
| 145 | ORF187_2_102980783_102983000_103034107_103047709_RR | NA |
| 146 | ORF187_6_157897501_157902533_158001619_158004030_RF | SNX9; SYNJ2 |
| 147 | ORF188_6_30104839_30106896_30143621_30146632_RR | TRIM31; TRIM40 |
| 148 | ORF19_20_46511970_46518882_46567001_46568090_RF | OCSTAMP; SLC13A3; ZNF334 |
| 149 | ORF19_8_86980479_86986149_87043788_87045089_RR | CNBD1; rs41486944 |
| 150 | ORF19_8_89837286_89838355_89905359_89910373_FR | OSGIN2 |
| 151 | ORF190_7_42842614_42843656_42886026_42890585_FF | C7orf25 |
| 152 | ORF191_2_102924054_102927148_102983000_102995309_FR | TMEM182 |
| 153 | ORF191_3_168579832_168593354_168619477_168632678_RF | NA |
| 154 | ORF191_5_6223946_6226870_6298491_6302848_FR | NA |
| 155 | ORF192_10_12596194_12598368_12616738_12619998_RF | CAMK1D |
| 156 | ORF193_5_90129888_90142322_90153362_90157668_RF | NA |
| 157 | ORF193_6_155189636_155191926_155219095_155222285_RR | TFB1M; TIAM2 |
| 158 | ORF195_20_11971793_11975460_11994892_11999282_FR | BTBD3; rs16992846 |
| 159 | ORF196_1_229821816_229824593_229859020_229862315_RR | GALNT2; rs4925506 |
| 160 | ORF197_1_66151966_66159635_66218811_66223865_FR | PDE4B; rs10454453; rs486438; rs490094; rs567279; rs6588190 |
| 161 | ORF197_13_110131405_110134324_110146402_110150942_FR | COL4A1; rs641862; rs672601348 |
| 162 | ORF197_15_69259199_69263452_69320948_69322275_RR | GLCE; PAQR5 |
| 163 | ORF197_4_22994756_23003981_23065929_23067873_FR | rs358231 |
| 164 | ORF198_9_28270698_28275294_28314155_28333777_RF | LINGO2; rs10812774; rs7357773 |

TABLE 2.b2

| | Probe_Count_Total | Probe_Count_Sig | HyperG_Stats |
|---|---|---|---|
| 83 | 15; 17; 104; 175 | 1; 1; 1; 1; 1; 1; 4; 4 | 0.335307856; 0.346011739; 0.350975055; 0.359834557; 0.067095696; 0.05179789; 0.096861772; 0.075450093 |
| 84 | 110 | 1; 4 | 0.055848211; 0.190296804 |
| 85 | 143 | 3; 2 | 0.107765005; 0.041422991 |
| 86 | 10; 8 | 2; 2; 2; 2 | 0.049739473; 0.05651991; 0.033505489; 0.038320555 |
| 87 | 42 | 1 | 0.320791853 |
| 88 | 26; 38 | 1; 1; 1; 1 | 0.375314357; 0.373699919; 0.340322106; 0.325888812 |
| 89 | 9 | 1 | 0.268692312 |
| 90 | 53 | 1; 2 | 0.261255041; 0.272683217 |
| 91 | NA | NA | NA |
| 92 | NA | NA | NA |

TABLE 2.b2-continued

| | Probe_Count_Total | Probe_Count_Sig | HyperG_Stats |
|---|---|---|---|
| 93 | 9; 27 | 1; 1; 2; 1 | 0.255358235; 0.268692312; 0.197546356; 0.37173223 |
| 94 | NA | NA | NA |
| 95 | 28; 28 | 3; 2; 2; 1 | 0.071800115; 0.219149094; 0.204457601; 0.369266824 |
| 96 | NA | NA | NA |
| 97 | 45 | 5; 5 | 0.022343156; 0.028833151 |
| 98 | 17 | 1; 2 | 0.350975055; 0.126473611 |
| 99 | 27; 27 | 1; 1 | 0.37173223; 0.37173223 |
| 100 | 21; 58 | 2; 1; 2; 1 | 0.149991246; 0.37425716; 0.271314317; 0.210195578 |
| 101 | 66; 117 | 1; 1; 2; 3 | 0.193835981; 0.169430739; 0.106169317; 0.143969124 |
| 102 | 110; 75 | 1; 4; 1 | 0.055848211; 0.190296804; 0.130607391 |
| 103 | 110 | 1; 4 | 0.055848211; 0.190296804 |
| 104 | 10; 8 | 2; 2; 2; 2 | 0.049739473; 0.05651991; 0.033505489; 0.038320555 |
| 105 | 60; 32 | 1; 1 | 0.199487628; 0.35529211 |
| 106 | 163; 163; 140 | 4; 2; 4; 2; 4; 2 | 0.117375195; 0.022678142; 0.117375195; 0.022678142; 0.158806697; 0.045194146 |
| 107 | 44 | 4; 3 | 0.063857117; 0.169607427 |
| 108 | 58 | 1 | 0.210195578 |
| 109 | 15; 9 | 1; 1 | 0.335307856; 0.255358235 |
| 110 | NA | NA | NA |
| 111 | 13 | 1 | 0.314642613 |
| 112 | 44 | 4; 3 | 0.063857117; 0.169607427 |
| 113 | 81 | 3; 3 | 0.227770757; 0.222648484 |
| 114 | NA | NA | NA |
| 115 | NA | NA | NA |
| 116 | 60 | 1; 2 | 0.22379944; 0.259153243 |
| 117 | 57 | 4; 2 | 0.110951788; 0.26588291 |
| 118 | 117 | 2; 3 | 0.106169317; 0.143969124 |
| 119 | 41 | 1; 2 | 0.325868449; 0.271883499 |
| 120 | 19 | 1 | 0.362286681 |
| 121 | NA | NA | NA |
| 122 | 22 | 1 | 0.372324987 |
| 123 | 11 | 1 | 0.288260522 |
| 124 | 2; 27; 27; 30 | 2; 1; 1; 1 | 0.001770535; 0.37173223; 0.37173223; 0.363021342 |
| 125 | 67 | 1; 1 | 0.189085999; 0.164740427 |
| 126 | 14 | 1; 1 | 0.325643034; 0.337131196 |
| 127 | NA | NA | NA |
| 128 | 98 | 2 | 0.1586416 |
| 129 | 60 | 5; 7 | 0.05512946; 0.009185497 |
| 130 | 54; 120 | 1; 1 | 0.255792527; 0.040862114 |
| 131 | 151; 84 | 1; 2; 1; 2 | 0.014886343; 0.032692527; 0.120373828; 0.181549809 |
| 132 | 31 | 1 | 0.366789724 |
| 133 | 16 | 2; 1 | 0.104530159; 0.353547066 |
| 134 | 25; 22 | 3; 4; 1; 2 | 0.05677955; 0.016055763; 0.372324987; 0.173304212 |
| 135 | 81; 71 | 1; 2; 1; 2 | 0.130826821; 0.192025586; 0.170848338; 0.226583412 |
| 136 | 14 | 3; 2 | 0.013899641; 0.096260668 |
| 137 | 28 | 1 | 0.373281001 |
| 138 | 93 | 2 | 0.17427462 |
| 139 | NA | NA | NA |
| 140 | 27 | 1 | 0.374553651 |
| 141 | 7; 2 | 1; 1 | 0.227740664; 0.080664005 |
| 142 | 78 | 2; 4 | 0.222357541; 0.186212358 |
| 143 | 22 | 3 | 5.07E−02 |
| 144 | 27 | 1; 2 | 0.374553651; 0.212429916 |
| 145 | NA | NA | NA |
| 146 | 50; 39 | 1; 1 | 0.255769837; 0.320372604 |
| 147 | 49; 30 | 1; 1 | 0.261686551; 0.363021342 |
| 148 | 66; 117; 15 | 1; 1; 2; 3; 1 | 0.193835981; 0.169430739; 0.106169317; 0.143969124; 0.346011739 |
| 149 | 20 | 1 | 0.366490901 |
| 150 | 14 | 1; 2 | 0.325643034; 0.096260668 |
| 151 | 34 | 1 | 0.346365974 |
| 152 | 27 | 2; 3 | 0.197546356; 0.077717327 |
| 153 | NA | NA | NA |
| 154 | NA | NA | NA |
| 155 | 41 | 1 | 0.309016356 |
| 156 | NA | NA | NA |
| 157 | 42; 42 | 1; 1 | 0.303213711; 0.303213711 |
| 158 | 33 | 1 | 0.360592644 |
| 159 | 44 | 4; 3 | 0.063857117; 0.169607427 |
| 160 | 17 | 3; 2 | 0.023054538; 0.126473611 |
| 161 | 98 | 2 | 0.1586416 |
| 162 | 85; 20 | 1; 1 | 0.096152866; 0.372098641 |
| 163 | NA | NA | NA |
| 164 | 20 | 6; 4 | 7.69e−05; 0.007618647 |

TABLE 2.b3

| | FDR_HyperG | Percent_Sig | logFC | AveExpr |
|---|---|---|---|---|
| 83 | 0.375519541; 0.376115439; 0.375519541; 0.376115439; 0.375519541; 0.376115439; 0.375519541; 0.376115439 | 6.67; 6.67; 5.88; 5.88; 0.96; 0.96; 2.29; 2.29 | −0.792992048 | −0.792992048 |
| 84 | 0.375519541; 0.376115439 | 0.91; 3.64 | −0.71786538 | −0.71786538 |
| 85 | 0.375519541; 0.376115439 | 2.1; 1.4 | −0.868846993 | −0.868846993 |
| 86 | 0.375519541; 0.376115439; 0.375519541; 0.376115439 | 20; 20; 25; 25 | −0.668469792 | −0.668469792 |
| 87 | 0.375519541 | 2.38 | −0.782974344 | −0.782974344 |
| 88 | 0.375519541; 0.376115439; 0.375519541; 0.376115439 | 3.85; 3.85; 2.63; 2.63 | −0.796548184 | −0.796548184 |
| 89 | 0.376115439 | 11.11 | −0.736621417 | −0.736621417 |
| 90 | 0.375519541; 0.376115439 | 1.89; 3.77 | −0.788346188 | −0.788346188 |
| 91 | NA | NA | −0.716810383 | −0.716810383 |
| 92 | NA | NA | −0.781758026 | −0.781758026 |
| 93 | 0.375519541; 0.376115439; 0.375519541; 0.376115439 | 11.11; 11.11; 7.41; 3.7 | −0.628076664 | −0.628076664 |
| 94 | NA | NA | −0.720386221 | −0.720386221 |
| 95 | 0.375519541; 0.376115439; 0.375519541; 0.376115439 | 10.71; 7.14; 7.14; 3.57 | −0.757155557 | −0.757155557 |
| 96 | NA | NA | −0.718991975 | −0.718991975 |
| 97 | 0.375519541; 0.376115439 | 11.11; 11.11 | −0.947138659 | −0.947138659 |
| 98 | 0.375519541; 0.376115439 | 5.88; 11.76 | −0.72720363 | −0.72720363 |
| 99 | 0.376115439; 0.376115439 | 3.7; 3.7 | −0.745245961 | −0.745245961 |
| 100 | 0.375519541; 0.376115439; 0.375519541; 0.376115439 | 9.52; 4.76; 3.45; 1.72 | −0.707334239 | −0.707334239 |
| 101 | 0.375519541; 0.376115439; 0.375519541; 0.376115439 | 1.52; 1.52; 1.71; 2.56 | −0.978256481 | −0.978256481 |
| 102 | 0.375519541; 0.376115439; 0.376115439 | 0.91; 3.64; 1.33 | −0.708665991 | −0.708665991 |
| 103 | 0.375519541; 0.376115439 | 0.91; 3.64 | −0.666227638 | −0.666227638 |
| 104 | 0.375519541; 0.376115439; 0.375519541; 0.376115439 | 20; 20; 25; 25 | −0.733776113 | −0.733776113 |
| 105 | 0.376115439; 0.376115439 | 1.67; 3.12 | −0.624247879 | −0.624247879 |
| 106 | 0.375519541; 0.376115439; 0.375519541; 0.376115439; 0.375519541; 0.376115439 | 2.45; 1.23; 2.45; 1.23; 2.86; 1.43 | −0.745666862 | −0.745666862 |
| 107 | 0.375519541; 0.376115439 | 9.09; 6.82 | −0.748947194 | −0.748947194 |
| 108 | 0.376115439 | 1.72 | −0.632299188 | −0.632299188 |
| 109 | 0.375519541; 0.375519541 | 6.67; 11.11 | −0.75272274 | −0.75272274 |
| 110 | NA | NA | −0.622972468 | −0.622972468 |
| 111 | 0.375519541 | 7.69 | −0.877638416 | −0.877638416 |
| 112 | 0.375519541; 0.376115439 | 9.09; 6.82 | −0.732135681 | −0.732135681 |
| 113 | 0.375519541; 0.376115439 | 3.7; 3.7 | −0.72169935 | −0.72169935 |
| 114 | NA | NA | −0.741191529 | −0.741191529 |
| 115 | NA | NA | −0.682677123 | −0.682677123 |
| 116 | 0.375519541; 0.376115439 | 1.67; 3.03 | −0.845149985 | −0.845149985 |
| 117 | 0.375519541; 0.376115439 | 7.02; 3.51 | −0.80602165 | −0.80602165 |
| 118 | 0.375519541; 0.376115439 | 1.71; 2.56 | −0.690428613 | −0.690428613 |
| 119 | 0.375519541; 0.376115439 | 2.44; 4.88 | −0.684279062 | −0.684279062 |
| 120 | 0.375519541 | 5.26 | −0.756728555 | −0.756728555 |
| 121 | NA | NA | −0.772400821 | −0.772400821 |
| 122 | 0.375519541 | 4.55 | −0.752005992 | −0.752005992 |
| 123 | 0.375519541 | 9.09 | −0.776274717 | −0.776274717 |
| 124 | 0.082088441; 0.376115439; 0.376115439; 0.376115439 | 100; 3.7; 3.7; 3.33 | −0.739742657 | −0.739742657 |
| 125 | 0.375519541; 0.376115439 | 1.49; 1.49 | −0.629601593 | −0.629601593 |
| 126 | 0.375519541; 0.376115439 | 7.14; 7.14 | −0.77209146 | −0.77209146 |
| 127 | NA | NA | −0.731244645 | −0.731244645 |
| 128 | 0.375519541 | 2.04 | −0.806448864 | −0.806448864 |
| 129 | 0.375519541; 0.275564898 | 8.33; 11.67 | −0.634548613 | −0.634548613 |
| 130 | 0.375519541; 0.375519541 | 1.85; 0.83 | −0.715276704 | −0.715276704 |
| 131 | 0.375519541; 0.376115439; 0.375519541; 0.376115439 | 0.66; 1.32; 1.19; 2.38 | −0.658137917 | −0.658137917 |
| 132 | 0.375519541 | 3.23 | −0.717405198 | −0.717405198 |
| 133 | 0.375519541; 0.376115439 | 12.5; 6.25 | −0.83682961 | −0.83682961 |
| 134 | 0.375519541; 0.376115439; 0.375519541; 0.376115439 | 12; 16; 4.55; 9.09 | −0.663906528 | −0.663906528 |
| 135 | 0.375519541; 0.376115439; 0.375519541; 0.376115439 | 1.23; 2.47; 1.41; 2.82 | −0.673376752 | −0.673376752 |
| 136 | 0.375519541; 0.376115439 | 21.43; 14.29 | −0.781589397 | −0.781589397 |
| 137 | 0.375519541 | 3.57 | −0.785820105 | −0.785820105 |
| 138 | 0.375519541 | 2.15 | −0.810473195 | −0.810473195 |
| 139 | NA | NA | −0.623437638 | −0.623437638 |
| 140 | 0.375519541 | 3.7 | −0.745678102 | −0.745678102 |
| 141 | 0.376115439; 0.376115439 | 14.29; 50 | −0.665598854 | −0.665598854 |
| 142 | 0.375519541; 0.376115439 | 2.56; 5.13 | −0.833911882 | −0.833911882 |
| 143 | 0.376115439 | 13.64 | −0.741040211 | −0.741040211 |
| 144 | 0.375519541; 0.376115439 | 3.7; 7.41 | −0.742388687 | −0.742388687 |
| 145 | NA | NA | −0.635385214 | −0.635385214 |
| 146 | 0.376115439; 0.376115439 | 2; 2.56 | −0.777208118 | −0.777208118 |

TABLE 2.b3-continued

|     | FDR_HyperG | Percent_Sig | logFC | AveExpr |
|-----|------------|-------------|-------|---------|
| 147 | 0.376115439; 0.376115439 | 2.04; 3.33 | −0.624302982 | −0.624302982 |
| 148 | 0.375519541; 0.376115439; 0.375519541; 0.376115439; 0.376115439 | 1.52; 0.85; 1.71; 20; 6.67 | −0.631933144 | −0.631933144 |
| 149 | 0.375519541 | 5 | −0.794820514 | −0.794820514 |
| 150 | 0.375519541; 0.376115439 | 7.14; 14.29 | −0.787561896 | −0.787561896 |
| 151 | 0.376115439 | 2.94 | −0.685208953 | −0.685208953 |
| 152 | 0.375519541; 0.376115439 | 7.41; 11.11 | −0.631706124 | −0.631706124 |
| 153 | NA | NA | −0.717890738 | −0.717890738 |
| 154 | NA | NA | −0.784153786 | −0.784153786 |
| 155 | 0.376115439 | 2.44 | −0.847700439 | −0.847700439 |
| 156 | NA | NA | −0.628772132 | −0.628772132 |
| 157 | 0.376115439; 0.376115439 | 2.38; 2.38 | −0.752750371 | −0.752750371 |
| 158 | 0.375519541 | 3.03 | −0.734645954 | −0.734645954 |
| 159 | 0.375519541; 0.376115439 | 9.09; 6.82 | −0.852475095 | −0.852475095 |
| 160 | 0.375519541; 0.376115439 | 17.65; 11.76 | −0.753556643 | −0.753556643 |
| 161 | 0.375519541 | 2.04 | −0.86271955 | −0.86271955 |
| 162 | 0.376115439; 0.376115439 | 1.18; 5 | −0.636957952 | −0.636957952 |
| 163 | NA | NA | −0.778465363 | −0.778465363 |
| 164 | 0.008046243; 0.242844385 | 30; 20 | −0.727431725 | −0.727431725 |

TABLE 2.b4

|     | t | P. Value | adj. P. Val | B | FC | FC_1 | LS |
|-----|---|----------|-------------|---|----|----|----|
| 83 | −6.315807727 | 0.0000388 | 0.000427828 | 2.235197344 | 0.57714589 | −1.732664163 | −1 |
| 84 | −5.537887222 | 0.000130736 | 0.00175879 | 1.067378001 | 0.607996372 | −1.644746656 | −1 |
| 85 | −6.889033657 | 0.0000169 | 0.000246775 | 3.094928994 | 0.547584307 | −1.826202809 | −1 |
| 86 | −6.947071281 | 0.0000159 | 0.000427061 | 3.233099187 | 0.629173673 | −1.589386275 | −1 |
| 87 | −5.985260916 | 0.000064 | 0.000606153 | 1.718491824 | 0.581167389 | −1.720674661 | −1 |
| 88 | −4.450496459 | 0.000802381 | 0.00624043 | −0.792357296 | 0.57572502 | −1.736940319 | −1 |
| 89 | −6.21630455 | 0.0000458 | 0.00086 | 2.14521907 | 0.600143156 | −1.666269105 | −1 |
| 90 | −14.15645318 | 0.00000000802 | 0.00000491 | 10.80928787 | 0.579007448 | −1.727093499 | −1 |
| 91 | −4.824893047 | 0.000417375 | 0.002330466 | −0.216233165 | 0.608441143 | −1.643544345 | −1 |
| 92 | −7.796152973 | 0.00000494 | 0.000109809 | 4.36473782 | 0.58165757 | −1.719224594 | −1 |
| 93 | −5.179949705 | 0.000233322 | 0.002635975 | 0.472450904 | 0.647038443 | −1.545503224 | −1 |
| 94 | −7.988184508 | 0.00000395 | 0.00017566 | 4.657828504 | 0.606934939 | −1.647623058 | −1 |
| 95 | −11.05181894 | 0.000000122 | 0.000011 | 8.14111358 | 0.591661712 | −1.690154998 | −1 |
| 96 | −7.538446204 | 0.00000709 | 0.000252002 | 4.059757678 | 0.607521775 | −1.646031535 | −1 |
| 97 | −9.857113647 | 0.000000424 | 0.0000234 | 6.881364823 | 0.518660117 | −1.928044913 | −1 |
| 98 | −7.456049368 | 0.00000791 | 0.000271777 | 3.947366204 | 0.604073653 | −1.655427272 | −1 |
| 99 | −8.637988348 | 0.00000176 | 0.000106054 | 5.477905517 | 0.596566156 | −1.676260026 | −1 |
| 100 | −6.714567946 | 0.0000217 | 0.000290609 | 2.838087003 | 0.612450759 | −1.632784327 | −1 |
| 101 | −10.76014022 | 0.000000164 | 0.0000132 | 7.845457749 | 0.507592803 | −1.970083094 | −1 |
| 102 | −9.426224608 | 0.000000704 | 0.0000597 | 6.407657613 | 0.611885666 | −1.634292246 | −1 |
| 103 | −6.576257223 | 0.000027 | 0.00060633 | 2.690445925 | 0.630152259 | −1.586918061 | −1 |
| 104 | −9.506988773 | 0.000000624 | 0.0000297 | 6.486427981 | 0.601327935 | −1.662986103 | −1 |
| 105 | −4.384389265 | 0.000900527 | 0.00678304 | −0.910115349 | 0.648757907 | −1.541407033 | −1 |
| 106 | −5.056523908 | 0.000282775 | 0.001751743 | 0.184531457 | 0.596392135 | −1.67674914 | −1 |
| 107 | −13.73693967 | 0.0000000108 | 0.00000294 | 10.55338696 | 0.595037628 | −1.680565991 | −1 |
| 108 | −7.655786319 | 0.00000607 | 0.0002294 | 4.218289153 | 0.64514744 | −1.550033277 | −1 |
| 109 | −8.225011167 | 0.00000286 | 0.0000771 | 4.928493509 | 0.593482445 | −1.684969807 | −1 |
| 110 | −5.179107163 | 0.000233645 | 0.002638339 | 0.471029649 | 0.649331693 | −1.540044959 | −1 |
| 111 | −7.390325566 | 0.00000846 | 0.000155288 | 3.809994153 | 0.544257612 | −1.837365209 | −1 |
| 112 | −7.181478305 | 0.0000112 | 0.000187721 | 3.51616598 | 0.602012071 | −1.661096262 | −1 |
| 113 | −10.8736462 | 0.00000000146 | 0.0000123 | 7.961387425 | 0.606382763 | −1.649123393 | −1 |
| 114 | −5.848734747 | 0.0000802 | 0.001260075 | 1.569399495 | 0.598245055 | −1.671555815 | −1 |
| 115 | −8.355041155 | 0.00000249 | 0.00013163 | 5.127022404 | 0.623008122 | −1.60511551 | −1 |
| 116 | −4.545515013 | 0.000680402 | 0.005586089 | −0.623936608 | 0.556652936 | −1.796451498 | −1 |
| 117 | −11.30872752 | 0.0000000948 | 0.0000095 | 8.395527795 | 0.571956904 | −1.748383477 | −1 |
| 118 | −7.393713894 | 0.0000086 | 0.000287838 | 3.861747456 | 0.619669724 | −1.613762883 | −1 |
| 119 | −11.311488 | 0.0000000981 | 0.0000182 | 8.378200295 | 0.62231673 | −1.606898788 | −1 |
| 120 | −12.5874418 | 0.0000000288 | 0.00000502 | 9.584177076 | 0.591836855 | −1.689654828 | −1 |
| 121 | −11.17482418 | 0.000000108 | 0.0000102 | 8.263613593 | 0.585442416 | −1.708109923 | −1 |
| 122 | −4.89393108 | 0.000371361 | 0.002140728 | −0.096068082 | 0.593777367 | −1.684132902 | −1 |
| 123 | −8.815642251 | 0.00000139 | 0.0000494 | 5.669027027 | 0.583872506 | −1.71270267 | −1 |
| 124 | −8.584546191 | 0.00000188 | 0.00011081 | 5.412348602 | 0.598846163 | −1.669877945 | −1 |
| 125 | −4.978576007 | 0.000325767 | 0.003332827 | 0.13004571 | 0.646354884 | −1.547137685 | −1 |
| 126 | −7.589537718 | 0.00000663 | 0.000241503 | 4.129003543 | 0.585567967 | −1.707743688 | −1 |
| 127 | −7.520101573 | 0.00000711 | 0.000138445 | 3.98969451 | 0.602384 | −1.660070653 | −1 |
| 128 | −5.965290044 | 0.000066 | 0.00061846 | 1.686778266 | 0.571787559 | −1.748901289 | −1 |
| 129 | −5.634803379 | 0.000112106 | 0.001578376 | 1.22537271 | 0.644142321 | −1.552451946 | −1 |
| 130 | −3.308889367 | 0.006249188 | 0.01792273 | −2.96908133 | 0.609088299 | −1.641798079 | −1 |
| 131 | −5.942956947 | 0.0000694 | 0.001140129 | 1.718846375 | 0.633695679 | −1.578044531 | −1 |
| 132 | −11.02081164 | 0.000000126 | 0.0000112 | 8.110031497 | 0.608190338 | −1.644222109 | −1 |
| 133 | −8.363302513 | 0.0000024 | 0.0000692 | 5.105530721 | 0.559872564 | −1.786120742 | −1 |

TABLE 2.b4-continued

|  | t | P. Value | adj. P. Val | B | FC | FC_1 | LS |
|---|---|---|---|---|---|---|---|
| 134 | −6.668910488 | 0.0000236 | 0.00055461 | 2.827829885 | 0.631166908 | −1.584366968 | −1 |
| 135 | −5.397162973 | 0.000163819 | 0.002062862 | 0.835607994 | 0.627037334 | −1.594801372 | −1 |
| 136 | −7.804152614 | 0.00000489 | 0.000109148 | 4.375462026 | 0.581725561 | −1.719023654 | −1 |
| 137 | −11.62912195 | 0.0000000696 | 0.00000801 | 8.705214587 | 0.580022148 | −1.724072096 | −1 |
| 138 | −14.01750686 | 0.00000000857 | 0.00000267 | 10.77710333 | 0.570194807 | −1.753786579 | −1 |
| 139 | −4.821038346 | 0.000424616 | 0.004001789 | −0.141536918 | 0.649122362 | −1.540541597 | −1 |
| 140 | −8.509898562 | 0.00000201 | 0.000062 | 5.290735411 | 0.596387489 | −1.676762203 | −1 |
| 141 | −8.40172753 | 0.00000235 | 0.000126547 | 5.185567401 | 0.630426964 | −1.586226569 | −1 |
| 142 | −9.175780457 | 0.000000937 | 0.0000711 | 6.119618276 | 0.561006005 | −1.782512115 | −1 |
| 143 | −6.644042082 | 0.0000244 | 0.000568491 | 2.791073734 | 0.598307805 | −1.671380502 | −1 |
| 144 | −5.023846785 | 0.00030207 | 0.003156555 | 0.20749253 | 0.597748833 | −1.672943459 | −1 |
| 145 | −7.558352653 | 0.00000691 | 0.000248079 | 4.086777794 | 0.643768899 | −1.553352455 | −1 |
| 146 | −6.725563218 | 0.0000217 | 0.000527303 | 2.911241487 | 0.583494872 | −1.71381112 | −1 |
| 147 | −7.603146606 | 0.00000651 | 0.000238774 | 4.147390992 | 0.648733128 | −1.541465908 | −1 |
| 148 | −6.513707717 | 0.0000295 | 0.000644318 | 2.597017253 | 0.645311149 | −1.549640049 | −1 |
| 149 | −8.946875037 | 0.00000119 | 0.0000444 | 5.828167604 | 0.576414881 | −1.734861527 | −1 |
| 150 | −8.928306451 | 0.00000125 | 0.0000853 | 5.828333194 | 0.5793223 | −1.726154855 | −1 |
| 151 | −5.036982396 | 0.000295538 | 0.003107408 | 0.229913584 | 0.621915745 | −1.60793485 | −1 |
| 152 | −5.175798027 | 0.00023492 | 0.002647023 | 0.465446654 | 0.645412702 | −1.549396219 | −1 |
| 153 | −7.239266686 | 0.0000106 | 0.000327941 | 3.647395871 | 0.607985685 | −1.644775566 | −1 |
| 154 | −6.560265983 | 0.0000276 | 0.00061648 | 2.666612596 | 0.580692463 | −1.722081935 | −1 |
| 155 | −8.230893339 | 0.00000291 | 0.000144892 | 4.970072391 | 0.555669732 | −1.799630146 | −1 |
| 156 | −6.837788953 | 0.0000185 | 0.000474048 | 3.075156549 | 0.646726606 | −1.546248432 | −1 |
| 157 | −10.206704 | 0.0000003 | 0.000036 | 7.264001976 | 0.593471078 | −1.685002078 | −1 |
| 158 | −10.09656308 | 0.000000327 | 0.00002 | 7.144474465 | 0.600965487 | −1.663989066 | −1 |
| 159 | −16.30777411 | 0.00000000152 | 0.00000115 | 12.43865494 | 0.553833761 | −1.805595959 | −1 |
| 160 | −5.619316939 | 0.000113274 | 0.000903523 | 1.128422057 | 0.593139501 | −1.68594403 | −1 |
| 161 | −6.034736926 | 0.0000593 | 0.000574116 | 1.796815874 | 0.549914964 | −1.818462972 | −1 |
| 162 | −6.502102235 | 0.00003 | 0.000651284 | 2.579621802 | 0.643067484 | −1.555046749 | −1 |
| 163 | −7.815132055 | 0.00000482 | 0.000108145 | 4.39016783 | 0.582986603 | −1.715305282 | −1 |
| 164 | −6.076430002 | 0.0000557 | 0.000548855 | 1.862549761 | 0.603978155 | −1.655689021 | −1 |

TABLE 2.b5

|  | Loop Detected | Probe sequence 60 mer | Probe Location Chr |
|---|---|---|---|
| 83 | sAD | AATGTTACTTATTATGATTATTAGATAATCGAAAAGGGGCCCTTTAGAACCCAAGGAAAA (SEQ ID NO: 1328) | 20 |
| 84 | mAD | ATTCTTTTAAACCTAAAATTAGACTGCTTCGAACTTTTGTTCATATCGTTATTCCCCCAA (SEQ ID NO: 1329) | 22 |
| 85 | sAD | AGCAATATGTTTTTAAGATTTATCCTCATCGATGAATCTTACAAAAGAAAATACAGAGTT (SEQ ID NO: 1330) | 4 |
| 86 | mAD | TATTTGCTAAAGAGATAATTCAGTGTTTTCGAAAAAAAATGGCCTCCTAGATTTTGTTTA (SEQ ID NO: 1331) | 5 |
| 87 | sAD | TATAATACCAGTATTTTCTCAAATAGAATCGATTTTTTTCACATCAACGTTACACCAAAA (SEQ ID NO: 1332) | 6 |
| 88 | mAD | GAAATGAGCCAATAATTTTTTTTTTTTTTCGATTAGCAATAATGATAATAACAAGGGTGA (SEQ ID NO: 1333) | X |
| 89 | mAD | GGGCTAACTTTATATTTTATAAAATGTAGTCGATCTTCGTTTGAAACACAAGGTCTATCAC (SEQ ID NO: 1334) | 2 |
| 90 | mAD | CTATAAAGTGATGATTTCTGAGATCTATTCGAGTGACTTAGTGATCCTGGGTATACACCC (SEQ ID NO: 1335) | 1 |
| 91 | sAD | ATGGTAAGTTTTGGGAATTCAAAGAACCTCGATTCTCAGCTATATCCTTAATACTGGAAG (SEQ ID NO: 1336) | 12 |
| 92 | sAD | GAATTATCAAATTATATTCCAGGTTTGTTCGATCATAAAGTTTGTAGGTTTGTAGAGCTG (SEQ ID NO: 1337) | 14 |
| 93 | mAD | AGGACAGAGTTTCAGAGTAAAATTTAATTCGAAAAACAAAAATAATAAATGCAATATTGA (SEQ ID NO: 1338) | 12 |
| 94 | mAD | ATTCACATAAAAAACTTTTTTGTGAACATCGAGTAAGTTCAAAACCCAACAAGGTGAATA (SEQ ID NO: 1339) | 3 |
| 95 | sAD | TTGTCTTTGCTGAGGAATCTCTCATAATTCGATTCTGAGTGAGGCTAAAAGCCACTGGAA (SEQ ID NO: 1340) | 6 |

TABLE 2.b5-continued

| Loop Detected | Probe sequence 60 mer | Probe Location Chr |
|---|---|---|
| 96 mAD | AAATTTCTGTAATAAAATGGGAGAAATGTCGAGTTGTTTCCAATAATTTTAAAAGATGGC (SEQ ID NO: 1341) | 4 |
| 97 sAD | TGCTCTTTTAGGATAGCTTGAAGTAATTTCGAAAGAAAGAGAAGTGAAAGTCTCTCTTTG (SEQ ID NO: 1342) | 1 |
| 98 mAD | GCAATTCATATAGTCTAAAAAATTTTAATCGATTGATTGTAGCTCAAACTGTAGAAATAG (SEQ ID NO: 1343) | 13 |
| 99 mAD | ATAGCCTAAAATAATGTTTTCAGTATTGTCGAATCTTTCCAATAAATTTGATATGTTTAC (SEQ ID NO: 1344) | 17 |
| 100 sAD | TCTTTTCTGTGGTTAAATTTTATAAGGATCGATTCAGCTGGGGAAAAATGAAAATAACAA (SEQ ID NO: 1345) | 2 |
| 101 sAD | GTAGCTGATTCAGTGGTGTTTATAAAGATCGATAGTTGCTTTGTTCTTCTTGTCTATGGT (SEQ ID NO: 1346) | 20 |
| 102 mAD | ATTCTTTTAAACCTAAAATTAGACTGCTTCGAGAGCCTCATAGATCTCTCTGAGGTACAG (SEQ ID NO: 1347) | 22 |
| 103 mAD | ATTCTTTTAAACCTAAAATTAGACTGCTTCGACAAATTTATGATGCCTACATCATGAAGG (SEQ ID NO: 1348) | 22 |
| 104 sAD | TAAACAAAATCTAGGAGGCCATTTTTTTTCGAAATATAATGTAGGAATATTAAAGAAAAT (SEQ ID NO: 1349) | 5 |
| 105 mAD | GGAACTATTACTTAAACTCTTAAACTCTTCGACATGATTAAGGTATTTCCCTTTTTCTCT (SEQ ID NO: 1350) | 6 |
| 106 sAD | TTATATTGGAAATCTGTTTCAACAATAATCGATTCAGCATAAAATAAATGCAAATGAAAG (SEQ ID NO: 1351) | 6 |
| 107 sAD | AACCGGTTTTGTCACAAACATTGAAAAATCGAAGAATGAATGGTGATGAGGAGATGTTTA (SEQ ID NO: 1352) | 1 |
| 108 mAD | TCTTTTCTTCCTTTTCTCTTTCTTCCTTTCGACTATTTTATTTTTTGTAGAGACGAGATC (SEQ ID NO: 1353) | 7 |
| 109 sAD | TTGGAAAAGGTAAATTGTGTTTTGTAAATCGAACATCAGGTCAGAATTCCAAAGGGGCGT (SEQ ID NO: 1354) | 6 |
| 110 mAD | GATTCAGAATGTCTAGTATTTTATTCAATCGATTGATTTTTCCAAAATCACTGCTTCAAA (SEQ ID NO: 1355) | 3 |
| 111 sAD | ACCATATGGTGACTTTATCTTTACTCCTTCGAGGGGAACTATTAAATATGAGTTAGGGTT (SEQ ID NO: 1356) | 7 |
| 112 sAD | AACCGGTTTTGTCACAAACATTGAAAAATCGATTTTCATTCTCAATGAATGTTGATCATC (SEQ ID NO: 1357) | 1 |
| 113 sAD | AGACTGGATCCGTCACTTTAGAACAGACTCGAGATTATCAGTAAGCTCTAGGGAAACTAG (SEQ ID NO: 1358) | 2 |
| 114 mAD | CTTCCAGTATTAAGGATATAGCTGAGAATCGAAGTCTCAGCTGAGGGATTACTTCTTCAG (SEQ ID NO: 1359) | 12 |
| 115 mAD | TCATTTTATCTGTCGTATCAAGAGCAATTCGACTGAGATGTCTGAAAGCCTAAAATATAA (SEQ ID NO: 1360) | 15 |
| 116 mAD | TGACACAGTGTAGATGTTTAATATATATTCGAGAATGTATATGGAAAGGCAGAGGAGCTA (SEQ ID NO: 1361) | 12 |
| 117 sAD | TTAATTCTTCCATATCTAAGCCTCTTTGTCGAAGAATATCTCTACTCGGCTGTAAATAAT (SEQ ID NO: 1362) | 2 |
| 118 mAD | CACCATTGCAAAGTTGAAAAATCGTATGTCGAGACATACTTATGAGCACCTACTATGTGC (SEQ ID NO: 1363) | 20 |
| 119 mAD | GCATTTTTATGAAATTAAATGTCCGTATTCGAAATAAAGCACAAGTGACTCCTTTCCTCA (SEQ ID NO: 1364) | 3 |
| 120 sAD | AATTCCATCTCAATTATAATTTTTTAACTCGATCTGCGATTGTTTGAATCTGCAGATGCA (SEQ ID NO: 1365) | 4 |
| 121 sAD | GATAATCAAAAAACATTTGTTGAATAGATCGAGTCCATGTCCAGTTGTTAATTCAATGTG | 5 |

TABLE 2.b5-continued

| Loop Detected | Probe sequence 60 mer | Probe Location Chr |
|---|---|---|
| | (SEQ ID NO: 1366) | |
| 122 sAD | GCTAGAATAATTACTATAGTCATGTTTTTCGAAATTAGTTACTTTAAGAAACCCCATATA (SEQ ID NO: 1367) | 6 |
| 123 sAD | TCTGTCTTTTTCTCAAGCAGGAAACATTTCGAGTGAGGAATTAAATTCATAGAGGTAACC (SEQ ID NO: 1368) | 1 |
| 124 mAD | AGTTTTTAATGTCAAATATGATATACAGTCGAAACAGTTATTTACTTTCAACTCTCTCAT (SEQ ID NO: 1369) | 5 |
| 125 mAD | TTCGTGTTTATTGTTTTCCATAAGAAATTCGATTGCATCTAACCTTTGGATCTCATTCAA (SEQ ID NO: 1370) | 18 |
| 126 mAD | AATTCTTCCCTAAGGATATTTATTAACTTCGATTTAGAAGTTACTTCCTTGTGGCCCTGG (SEQ ID NO: 1371) | 11 |
| 127 sAD | GTTGACTCTTAGAACAACGGAAAAACTATCGAAAATGGGTTCTGTTTCAAATACATGGAA (SEQ ID NO: 1372) | 14 |
| 128 sAD | TTTAAACTGATAAGAACAGATATTACCCTCGAATTATTGCAACAACCTGTTAATCTGGTG (SEQ ID NO: 1373) | 13 |
| 129 mAD | GAGATTTTCTTAAGACGGTAATTCTTAATCGAGTTACTCAAAGACCAAGGGGCTTAAAAA (SEQ ID NO: 1374) | 2 |
| 130 sAD | CTTAAAGCTGTCTAAATTTTATCTTAGTTCGAGGCCCTTTCAGGACTCTTTTCCTGGGGA (SEQ ID NO: 1375) | 19 |
| 131 mAD | ATTGTGACAATCACATTTTAAGTACTCTTCGAAAGAGAATGATCTGAACATTTTAGGATG (SEQ ID NO: 1376) | 3 |
| 132 sAD | TGTTAATTTTCAGTAGGTTTCCTAAGTGTCGAGCTTCCATTTTCTCTCTGACTTCACGTT (SEQ ID NO: 1377) | 1 |
| 133 sAD | TGTCAATTTTCAATATAATTCATACAGTTCGACTTTCACTACGACTCTGAGGGAGGTTCT (SEQ ID NO: 1378) | 1 |
| 134 mAD | CATATGAGAAAGTGGAAAAGATTTAAAATCGAATGAAAAATGAAATCATGCTATGCCTTT (SEQ ID NO: 1379) | 11 |
| 135 mAD | ATTACTAGTTTATTATACAGTTTGGACCTCGAGGGACAGCAGTAAATTTACAACCCAAAG (SEQ ID NO: 1380) | 14 |
| 136 sAD | AACTCTTCCATAAAGATTTATCAAAAATTCGATTTTATTCATTTTATTTTGATGTTOCCA (SEQ ID NO: 1381) | 3 |
| 137 sAD | GTCTGGCATTGTGGAATACTCAATTACATCGAAAAAAAAAAGAAAAAGAAAAAAGAAAAA (SEQ ID NO: 1382) | 5 |
| 138 sAD | TGTTTATCTCAAAAGAAGCTCAGAAAACTCGATTTTTAAGAGTCAAAGATTTTGATTTAA (SEQ ID NO: 1383) | 6 |
| 139 mAD | CTCATCTTTGTTAATTCAGATCTATTTTTCGAAAGTATTTAGCAGGTCATGAAACACAAA (SEQ ID NO: 1384) | 14 |
| 140 sAD | TACATATAGCAAGATAGAAGAAATAACTTCGAAAAGATTTTGATGTTTTGTTTATAAAGA (SEQ ID NO: 1385) | 5 |
| 141 mAD | GTTTCTTTTTAATTCTTCATAATACCCTTCGACCTTGGTTCTCTCCCTTTCTAGGGCTTG (SEQ ID NO: 1386) | 3 |
| 142 mAD | TCTCAAATATACTTATAAACAAAGGGTTCGATGCATAAATATGCATCTATAATATGTTT (SEQ ID NO: 1387) | 8 |
| 143 mAD | GTATATATATATATATATATATATGATCGAATGGCAGCTCTACTTTCATTTCCTTAAG (SEQ ID NO: 1388) | 10 |
| 144 mAD | GAGTATTTAAGATAGGTGCCTATTATCCTCGATTATCTCTTTATGACGTTTATTAGACAA (SEQ ID NO: 1389) | 2 |
| 145 mAD | AAAAAACCTTTATAAAGAGAAGAGAAAATCGATTTCATTCTTTTAAGCTTTCCCAACACT (SEQ ID NO: 1390) | 2 |
| 146 mAD | TATTTATTTTTATCATAAGCCATGTTGTTCGATTATTGTTATTATTATTCTTTGAGACAG (SEQ ID NO: 1391) | 6 |

TABLE 2.b5-continued

| Loop Detected | Probe sequence 60 mer | Probe Location Chr |
|---|---|---|
| 147 mAD | ATTTGCTGCCCCTACAGGGCAGCAGGTTTCGACTATTTTCTAGATTTCAACTTGTCTTTT (SEQ ID NO: 1392) | 6 |
| 148 mAD | GCTTACTCAGAACTTAAAAATTTCATAATCGAATACTCTTCTCTGATGCTGAATTTTATA (SEQ ID NO: 1393) | 20 |
| 149 sAD | CCTGAGTTGGTGAATTTTGTATGCTTTCTCGATGTTTCTAAAAACTCATTATTTCTTTAG (SEQ ID NO: 1394) | 8 |
| 150 mAD | ACCAAGCAGAACTGTATTTAAAACAAATTCGAAGAAAAGTAGATTTTTATTACTCAAAA (SEQ ID NO: 1395) | 8 |
| 151 mAD | TCTTCAATAACAGTATTTCTAAAATGTTTCGAATGTCATCAATGTATGTATTAAGTGAGT (SEQ ID NO: 1396) | 7 |
| 152 mAD | TCACACTAATTTGTTAAATGCAAGTTTATCGATTTCACCAAGTTTGCAAAAGATTCTGTG (SEQ ID NO: 1397) | 2 |
| 153 mAD | TTTGGATGTGTCATAATCTACTTAAAATTCGATACTTATCTTTACAAAACGCAAGAATAA (SEQ ID NO: 1398) | 3 |
| 154 mAD | TATCTAGATGTAGGTATATATTTATCTATCGATATCTCTGTTTTCTTTTGACTGGTGGTT (SEQ ID NO: 50) | 5 |
| 155 mAD | TTTTCACTCAACTTTCACTGGAGATTTATCGACAAAATAAATGTAGTAGAATTTCTTTGA (SEQ ID NO: 1400) | 10 |
| 156 mAD | TTCACACAAGATAGAAAATCATTAAAACTCGAGGAGAACCTTCTAATAAGAGATGATCAA (SEQ ID NO: 1401) | 5 |
| 157 mAD | ATAATGTGTAATTCACCTTTATGTACCTTCGAAGTTAGTGTCAGTGGTCAACTTCTCCCG (SEQ ID NO: 1402) | 6 |
| 158 sAD | AATTCTTCATCCTTCCTTACATGTGTTATCGAAAAGACAGGTATTTGCATGATTTTTTTT (SEQ ID NO: 1403) | 20 |
| 159 sAD | TTCCTTCTTAATCAATTCAAGAGCATGTTCGATTTATAACAAAAATAAACACTGTAGAAA (SEQ ID NO: 1404) | 1 |
| 160 sAD | TTGTAAAGTGCTATAGATAATAGGATTTTCGATAGAGTTAAATACATTTTGGTTGGATGG (SEQ ID NO: 1405) | 1 |
| 161 sAD | TTTAAACTGATAAGAACAGATATTACCCTCGAAATGTAGTAAGTAAAACCATAAAACTTT (SEQ ID NO: 1406) | 13 |
| 162 mAD | CATTTTTAAAAAACTCCACTTATCACATTCGAATATTTTCCGCCGACAAGGCCTTTTGGC (SEQ ID NO: 1407) | 15 |
| 163 sAD | GTAAAAACAAAGCAAATTCTTCAAAATTTCGAATGAATAAAAAATTCATAAAAATAAGGC (SEQ ID NO: 1408) | 4 |
| 164 sAD | AAAGTCATACAACTACTATGTAAGATATTCGAATTTGTGCTTGTTGGGAAAATAGTAATT (SEQ ID NO: 1409) | 9 |

TABLE 2.b6

| | Probe Location | | | | 4 kb Sequence Location | | | | |
|---|---|---|---|---|---|---|---|---|---|
| | Start1 | End1 | Start2 | End2 | Chr | Start1 | End1 | Start2 | End2 |
| 83 | 20006512 | 20006543 | 20074979 | 20075010 | 20 | 20002542 | 20006543 | 20074979 | 20078980 |
| 84 | 25695448 | 25695479 | 25711627 | 25711658 | 22 | 25691478 | 25695479 | 25711627 | 25715628 |
| 85 | 152196799 | 152196830 | 152218333 | 152218364 | 4 | 152192829 | 152196830 | 152214363 | 152218364 |
| 86 | 39119119 | 39119150 | 39150069 | 39150100 | 5 | 39115149 | 39119150 | 39146099 | 39150100 |
| 87 | 168253924 | 168253955 | 168295233 | 168295264 | 6 | 168253924 | 168257925 | 168291263 | 168295264 |
| 88 | 134214353 | 134214384 | 134250930 | 134250961 | X | 134210383 | 134214384 | 134246960 | 134250961 |
| 89 | 156267571 | 156267602 | 156333728 | 156333759 | 2 | 156263601 | 156267602 | 156333728 | 156337729 |
| 90 | 213954211 | 213954242 | 214032320 | 214032351 | 1 | 213954211 | 213958212 | 214028350 | 214032351 |
| 91 | 30089465 | 30089496 | 30144610 | 30144641 | 12 | 30089465 | 30093466 | 30144610 | 30148611 |
| 92 | 25834224 | 25834255 | 25940164 | 25940195 | 14 | 25830254 | 25834255 | 25936194 | 25940195 |
| 93 | 82610099 | 82610130 | 82624217 | 82624248 | 12 | 82606129 | 82610130 | 82624217 | 82628218 |
| 94 | 106249641 | 106249672 | 106284173 | 106284204 | 3 | 106245671 | 106249672 | 106280203 | 106284204 |
| 95 | 115981175 | 115981206 | 116082282 | 116082313 | 6 | 115981175 | 115985176 | 116082282 | 116086283 |
| 96 | 22918077 | 22918108 | 22970139 | 22970170 | 4 | 22914107 | 22918108 | 22970139 | 22974140 |

TABLE 2.b6-continued

| | Probe Location | | | | 4 kb Sequence Location | | | | |
|---|---|---|---|---|---|---|---|---|---|
| | Start1 | End1 | Start2 | End2 | Chr | Start1 | End1 | Start2 | End2 |
| 97 | 76003880 | 76003911 | 76083373 | 76083404 | 1 | 75999910 | 76003911 | 76083373 | 76087374 |
| 98 | 33822756 | 33822787 | 33864974 | 33865005 | 13 | 33822756 | 33826757 | 33864974 | 33868975 |
| 99 | 4315306 | 4315337 | 4363166 | 4363197 | 17 | 4311336 | 4315337 | 4363166 | 4367167 |
| 100 | 39609951 | 39609982 | 39623225 | 39623256 | 2 | 39605981 | 39609982 | 39623225 | 39627226 |
| 101 | 46574127 | 46574158 | 46633792 | 46633823 | 20 | 46570157 | 46574158 | 46629822 | 46633823 |
| 102 | 25569452 | 25569483 | 25695448 | 25695479 | 22 | 25569452 | 25573453 | 25691478 | 25695479 |
| 103 | 25661627 | 25661658 | 25695448 | 25695479 | 22 | 25661627 | 25665628 | 25691478 | 25695479 |
| 104 | 39119150 | 39119181 | 39150069 | 39150100 | 5 | 39119150 | 39123151 | 39146099 | 39150100 |
| 105 | 13526281 | 13526312 | 13559103 | 13559134 | 6 | 13526281 | 13530282 | 13559103 | 13563104 |
| 106 | 154154477 | 154154508 | 154217494 | 154217525 | 6 | 154154477 | 154158478 | 154217494 | 154221495 |
| 107 | 229855687 | 229855718 | 229872977 | 229873008 | 1 | 229851717 | 229855718 | 229869007 | 229873008 |
| 108 | 112014904 | 112014935 | 112124185 | 112124216 | 7 | 112014904 | 112018905 | 112124185 | 112128186 |
| 109 | 46989661 | 46989692 | 47069677 | 47069708 | 6 | 46989661 | 46993662 | 47065707 | 47069708 |
| 110 | 177784072 | 177784103 | 177834794 | 177834825 | 3 | 177780102 | 177784103 | 177830824 | 177834825 |
| 111 | 29763050 | 29763081 | 29809501 | 29809532 | 7 | 29763050 | 29767051 | 29809501 | 29813502 |
| 112 | 229855687 | 229855718 | 229911260 | 229911291 | 1 | 229851717 | 229855718 | 229907290 | 229911291 |
| 113 | 195503344 | 195503375 | 195566638 | 195566669 | 2 | 195499374 | 195503375 | 195562668 | 195566669 |
| 114 | 30144610 | 30144641 | 30181629 | 30181660 | 12 | 30144610 | 30148611 | 30181629 | 30185630 |
| 115 | 95109397 | 95109428 | 95167989 | 95168020 | 15 | 95109397 | 95113398 | 95164019 | 95168020 |
| 116 | 14122272 | 14122303 | 14160805 | 14160836 | 12 | 14122272 | 14126273 | 14156835 | 14160836 |
| 117 | 66362739 | 66362770 | 66470726 | 66470757 | 2 | 66358769 | 66362770 | 66466756 | 66470757 |
| 118 | 46570679 | 46570710 | 46643075 | 46643106 | 20 | 46566709 | 46570710 | 46643075 | 46647076 |
| 119 | 64195292 | 64195323 | 64225983 | 64226014 | 3 | 64191322 | 64195323 | 64225983 | 64229984 |
| 120 | 105417618 | 105417649 | 105460123 | 105460154 | 4 | 105413648 | 105417649 | 105456153 | 105460154 |
| 121 | 162413257 | 162413288 | 162474154 | 162474185 | 5 | 162413257 | 162417258 | 162470184 | 162474185 |
| 122 | 82571438 | 82571469 | 82630737 | 82630768 | 6 | 82567468 | 82571469 | 82630737 | 82634738 |
| 123 | 58212403 | 58212434 | 58252312 | 58252343 | 1 | 58212403 | 58216404 | 58248342 | 58252343 |
| 124 | 132790667 | 132790698 | 132849773 | 132849804 | 5 | 132790667 | 132794668 | 132845803 | 132849804 |
| 125 | 11015786 | 11015817 | 11118494 | 11118525 | 18 | 11015786 | 11019787 | 11118494 | 11122495 |
| 126 | 75842855 | 75842886 | 75864693 | 75864724 | 11 | 75842855 | 75846856 | 75860723 | 75864724 |
| 127 | 39724648 | 39724679 | 39792290 | 39792321 | 14 | 39720678 | 39724679 | 39792290 | 39796291 |
| 128 | 110134293 | 110134324 | 110153678 | 110153709 | 13 | 110130323 | 110134324 | 110153678 | 110157679 |
| 129 | 209662023 | 209662054 | 209702177 | 209702208 | 2 | 209658053 | 209662054 | 209698207 | 209702208 |
| 130 | 29325557 | 29325588 | 29376361 | 29376392 | 19 | 29325557 | 29329558 | 29376361 | 29380362 |
| 131 | 69172531 | 69172562 | 69218117 | 69218148 | 3 | 69168561 | 69172562 | 69218117 | 69222118 |
| 132 | 107900199 | 107900230 | 107960595 | 107960626 | 1 | 107900199 | 107904200 | 107960595 | 107964596 |
| 133 | 8397345 | 8397376 | 8424469 | 8424500 | 1 | 8397345 | 8401346 | 8420499 | 8424500 |
| 134 | 49141691 | 49141722 | 49212875 | 49212906 | 11 | 49137721 | 49141722 | 49212875 | 49216876 |
| 135 | 89954051 | 89954082 | 89987664 | 89987695 | 14 | 89950081 | 89954082 | 89983694 | 89987695 |
| 136 | 24259095 | 24259126 | 24324961 | 24324992 | 3 | 24255125 | 24259126 | 24320991 | 24324992 |
| 137 | 88780146 | 88780177 | 88890370 | 88890401 | 5 | 88780146 | 88784147 | 88886406 | 88890401 |
| 138 | 137232223 | 137232254 | 137343854 | 137343885 | 6 | 137232223 | 137236224 | 137339884 | 137343885 |
| 139 | 106693397 | 106693428 | 106729764 | 106729795 | 14 | 106693397 | 106697398 | 106725794 | 106729795 |
| 140 | 148931403 | 148931434 | 149013571 | 149013602 | 5 | 148931403 | 148935404 | 149013571 | 149017572 |
| 141 | 45968082 | 45968113 | 46028527 | 46028558 | 3 | 45968082 | 45972083 | 46024557 | 46028558 |
| 142 | 52230322 | 52230353 | 52319467 | 52319498 | 8 | 52230322 | 52234323 | 52319467 | 52323468 |
| 143 | 89827266 | 89827297 | 89863078 | 89863109 | 10 | 89827266 | 89831267 | 89863078 | 89867079 |
| 144 | 198037606 | 198037637 | 198099686 | 198099717 | 2 | 198037606 | 198041607 | 198099686 | 198103687 |
| 145 | 102980783 | 102980814 | 103034107 | 103034138 | 2 | 102980783 | 102984784 | 103034107 | 103038108 |
| 146 | 157897501 | 157897532 | 158003999 | 158004030 | 6 | 157897501 | 157901502 | 158000029 | 158004030 |
| 147 | 30104839 | 30104870 | 30143621 | 30143652 | 6 | 30104839 | 30108840 | 30143621 | 30147622 |
| 148 | 46511970 | 46512001 | 46568059 | 46568090 | 20 | 46511970 | 46515971 | 46564089 | 46568090 |
| 149 | 86980479 | 86980510 | 87043788 | 87043819 | 8 | 86980479 | 86984480 | 87043788 | 87047789 |
| 150 | 89838324 | 89838355 | 89905359 | 89905390 | 8 | 89834354 | 89838355 | 89905359 | 89909360 |
| 151 | 42843625 | 42843656 | 42890554 | 42890585 | 7 | 42839655 | 42843656 | 42886584 | 42890585 |
| 152 | 102927117 | 102927148 | 102983000 | 102983031 | 2 | 102923147 | 102927148 | 102983000 | 102987001 |
| 153 | 168579832 | 168579863 | 168632647 | 168632678 | 3 | 168579832 | 168583833 | 168628677 | 168632678 |
| 154 | 6226839 | 6226870 | 6298491 | 6298522 | 5 | 6222869 | 6226870 | 6298491 | 6302492 |
| 155 | 12596194 | 12596225 | 12619967 | 12619998 | 10 | 12596194 | 12600195 | 12615997 | 12619998 |
| 156 | 90129888 | 90129919 | 90157637 | 90157668 | 5 | 90129888 | 90133889 | 90153667 | 90157668 |
| 157 | 155189636 | 155189667 | 155219095 | 155219126 | 6 | 155189636 | 155193637 | 155219095 | 155223096 |
| 158 | 11975429 | 11975460 | 11994892 | 11994923 | 20 | 11971459 | 11975460 | 11994892 | 11998893 |
| 159 | 229821816 | 229821847 | 229859020 | 229859051 | 1 | 229821816 | 229825817 | 229859020 | 229863021 |
| 160 | 66159604 | 66159635 | 66218811 | 66218842 | 1 | 66155634 | 66159635 | 66218811 | 66222812 |
| 161 | 110134293 | 110134324 | 110146402 | 110146433 | 13 | 110130323 | 110134324 | 110146402 | 110150403 |
| 162 | 69259199 | 69259230 | 69320948 | 69320979 | 15 | 69259199 | 69263200 | 69320948 | 69324949 |
| 163 | 23003950 | 23003981 | 23065929 | 23065960 | 4 | 22999980 | 23003981 | 23065929 | 23069930 |
| 164 | 28270698 | 28270729 | 28333746 | 28333777 | 9 | 28270698 | 28274699 | 28329776 | 28333777 |

TABLE 2.b7

| Probe | PCR-Primer1_ID | PCR_Primer1 |
|---|---|---|
| 83 ORF15_20_20005082_20006543_20074979_20078974_FR | OBD159_1033 | GGCACCACACCACAAGCACTGTT (SEQ ID NO: 1410) |
| 84 ORF15_22_25694410_25695479_25711627_25712666_FR | OBD159_1037 | ATGTGCTAATCTGGAAGACTCTGTC (SEQ ID NO: 1411) |
| 85 ORF15_4_152191742_152196830_152216416_152218364_FF | OBD159_1041 | GGTATCCTGTGAAACTTGCTTCCTTA (SEQ ID NO: 1412) |
| 86 ORF15_5_39114378_39119150_39147583_39150100_FF | OBD159_1045 | TTTTGTGTCATCTGTGGTTTGTAT (SEQ ID NO: 1413) |
| 87 ORF15_6_168253924_168260809_168288516_168295264_RF | OBD159_1049 | CTCCAACTGTTCTCCTGAGCCGC (SEQ ID NO: 1414) |
| 88 ORF15_X_134208394_134214384_134247371_134250961_FF | OBD159_1053 | CTTTTGTGCTCCCAAGAATACTATCA (SEQ ID NO: 1415) |
| 89 ORF150_2_156262877_156267602_156333728_156335220_FR | OBD159_1057 | GAAGTCCATTCTTGGGATGAAACAAA (SEQ ID NO: 1416) |
| 90 ORF151_1_213954211_213958027_214030463_214032351_RF | OBD159_1061 | ACCAAAGTCTCCTCCAGGGCATCTT (SEQ ID NO: 1417) |
| 91 ORF151_12_30089465_30094558_30144610_30146709_RR | OBD159_1065 | AGGCTTCCTTGTTGTGTTCATAAT (SEQ ID NO: 1418) |
| 92 ORF151_14_25830955_25834255_25934805_25940195_FF | OBD159_1069 | AGGAAGGAAAGATGTCTACCAAAT (SEQ ID NO: 1419) |
| 93 ORF152_12_82605920_82610130_82624217_82631901_FR | OBD159_1073 | CGTGACGAACTGAAGCAGACCCTTC (SEQ ID NO: 1420) |
| 94 ORF152_3_106246431_106249672_106270924_106284204_FF | OBD159_1077 | CACCATCATTTCCCGCCCTTGTC (SEQ ID NO: 1421) |
| 95 ORF152_6_115981175_115984851_116082282_116083649_RR | OBD159_1081 | GCTCTGAAAACAACTAACGGTGTA (SEQ ID NO: 1422) |
| 96 ORF155_4_22917017_22918108_22970139_22978081_FR | OBD159_1085 | TCTTGAGATGAAATGCCTGTTTGC (SEQ ID NO: 1423) |
| 97 ORF16_1_76000194_76003911_76083373_76086337_FR | OBD159_1089 | CTCAGGCAGAAGCAGAACTTGGCTCT (SEQ ID NO: 1424) |
| 98 ORF16_13_33822756_33828516_33864974_33872117_RR | OBD159_1093 | TCCAGGTATCTACTTTTCTTCTAT (SEQ ID NO: 1425) |
| 99 ORF16_17_4314279_4315337_4363166_4364509_FR | OBD159_1097 | GGGCTAAGATAGGTGAAACGAGGCTG (SEQ ID NO: 1426) |
| 100 ORF16_2_39607186_39609982_39623225_39627003_FR | OBD159_1101 | GCTTAGATGTGGCTTTGTCTTTTCTC (SEQ ID NO: 1427) |
| 101 ORF16_20_46570710_46574158_46631132_46633823_FF | OBD159_1105 | CCTCCTTTTGCCTCCGATTCCTCATC (SEQ ID NO: 1428) |
| 102 ORF16_22_25569452_25577394_25694410_25695479_RF | OBD159_1109 | GTGCTAATCTGGAAGACTCTGTC (SEQ ID NO: 1429) |
| 103 ORF16_22_25661627_25666380_25694410_25695479_RF | OBD159_1113 | TGTGCTAATCTGGAAGACTCTGTC (SEQ ID NO: 1430) |
| 104 ORF16_5_39119150_39126856_39147583_39150100_RF | OBD159_1117 | CCAGCCTTATGACTTTCAGTGTG (SEQ ID NO: 1431) |
| 105 ORF16_6_13526281_13531876_13559103_13561354_RR | OBD159_1121 | GTGCCTCAGTTTTCCTCATCCCTAAG (SEQ ID NO: 1432) |
| 106 ORF16_6_154154477_154163186_154217494_154220454_RR | OBD159_1125 | TGGCAGTCATCAAAATCGCTTCTA (SEQ ID NO: 1433) |
| 107 ORF161_1_229849427_229855718_229869805_229873008_FF | OBD159_1129 | GCTTTGCTTCACAGGCTTGCCCA (SEQ ID NO: 1434) |
| 108 ORF161_7_112014904_112016980_112124185_112133295_RR | OBD159_1133 | TGCCACCCAGTAGGTCTCAGTCT (SEQ ID NO: 1435) |

TABLE 2.b7-continued

| Probe | PCR-Primer1_ID | PCR_Primer1 |
|---|---|---|
| 109 ORF162_6_46989661_46997140_47060758_47069708_RF | OBD159_1137 | GGTTGCTGGCTGGAGTCTTCTGA (SEQ ID NO: 1436) |
| 110 ORF163_3_177780034_177784103_177831413_177834825_FF | OBD159_1141 | ATGTGAGTGTTCCTTGTAGATTAC (SEQ ID NO: 1437) |
| 111 ORF166_7_29763050_29768509_29809501_29813015_RR | OBD159_1145 | GAAGAGACCTTATCCTTTTGAACTAC (SEQ ID NO: 1438) |
| 112 ORF167_1_229849427_229855718_229908605_229911291_FF | OBD159_1149 | CCACCGATTTATTGCCCTGTAGGACA (SEQ ID NO: 1322) |
| 113 ORF167_2_195495210_195503375_195555062_195566669_FF | OBD159_1153 | ACTCTGGCTCCGTTTCTTCCCTGACT (SEQ ID NO: 1440) |
| 114 ORF168_12_30144610_30146709_30181629_30184999_RR | OBD159_1157 | CATTCTTCCCTCAGCCATCCATTTGG (SEQ ID NO: 1441) |
| 115 ORF169_15_95109397_95110442_95161353_95168020_RF | OBD159_1161 | GCCATAGAGCCTTCCCTGAACAGAGA (SEQ ID NO: 1442) |
| 116 ORF17_12_14122272_14125684_14156567_14160836_RF | OBD159_1165 | AATACTCCTCAGAGAACCAATAAT (SEQ ID NO: 1443) |
| 117 ORF17_2_66361342_66362770_66462513_66470757_FF | OBD159_1169 | CCCTTCCCTTGGCTTTTGAGTCTGAA (SEQ ID NO: 1444) |
| 118 ORF17_20_46568090_46570710_46643075_46649811_FR | OBD159_1173 | TCTACAAGAGAGTGTCCCACCACATA (SEQ ID NO: 1445) |
| 119 ORF17_3_64194265_64195323_64225983_64228797_FR | OBD159_1177 | CCAGCCCTCTGTTCTGCTACCAT (SEQ ID NO: 1446) |
| 120 ORF17_4_105415477_105417649_105457783_105460154_FF | OBD159_1181 | TGAGAGGTTATGACTTTTCCGAGGTC (SEQ ID NO: 1447) |
| 121 ORF17_5_162413257_162414861_162467630_162474185_RF | OBD159_1185 | GGCTAAAATACAAATCCCACAAGAAG (SEQ ID NO: 1448) |
| 122 ORF17_6_82564978_82571469_82630737_82633712_FR | OBD159_1189 | GGATTGAAGGTCTCTATTATCAGTCA (SEQ ID NO: 1449) |
| 123 ORF170_1_58212403_58221374_58250279_58252343_RF | OBD159_1193 | AGTAATGCCAGCCCCTGAACCCATCT (SEQ ID NO: 1450) |
| 124 ORF170_5_132790667_132795213_132845490_132849804_RF | OBD159_1197 | GGCAATGGTCAAGGGCACGAACACAA (SEQ ID NO: 1451) |
| 125 ORF171_18_11015786_11021011_11118494_11119843_RR | OBD159_1201 | GAGAATGTCACCAGGATTGCCCAAGC (SEQ ID NO: 1452) |
| 126 ORF172_11_75842855_75846190_75861382_75864724_RF | OBD159_1205 | GGCACACAGAAGACGCTCAGCAA (SEQ ID NO: 1453) |
| 127 ORF173_14_39721868_39724679_39792290_39806170_FR | OBD159_1209 | GTGTTTCATTTCCTTATCATTTCA (SEQ ID NO: 1454) |
| 128 ORF174_13_110131405_110134324_110153678_110157618_FR | OBD159_1213 | ACACAAAGTCAGGAAGGGTGCGTGAA (SEQ ID NO: 1455) |
| 129 ORF174_2_209659511_209662054_209697743_209702208_FF | OBD159_1217 | CAGGTATTGCCAGCCACAGCGTTTGA (SEQ ID NO: 298) |
| 130 ORF175_19_29325557_29328725_29376361_29378170_RR | OBD159_1221 | AGATGTGTGTGGGCTCTCGGGCT (SEQ ID NO: 1457) |
| 131 ORF175_3_69167897_69172562_69218117_69221087_FR | OBD159_1225 | GTGTCTCGGAGTCTCTTTGAACCAGC (SEQ ID NO: 1458) |
| 132 ORF18_1_107900199_107901840_107960595_107963096_RR | OBD159_1229 | GCATAAAGGTAACTTCCTCCTGACG (SEQ ID NO: 1459) |
| 133 ORF18_1_8397345_8398792_8423193_8424500_RF | OBD159_1233 | CCAGTAGTGGAGGCTTTGCGTTTT (SEQ ID NO: 1460) |
| 134 ORF18_11_49136317_49141722_49212875_49219818_FR | OBD159_1237 | GCTACAGCAGTGTTTAGAGGGAA |

TABLE 2.b7-continued

| Probe | PCR-Primer1_ID | PCR_Primer1 |
|-------|----------------|-------------|
| | | (SEQ ID NO: 1461) |
| 135ORF18_14_89952946_89954082_89986309_89987695_FF | OBD159_1241 | ACCCAAACAGCATTACAACAGCAGTT (SEQ ID NO: 1462) |
| 136ORF18_3_24254159_24259126_24320266_24324992_FF | OBD159_1245 | TCCTGATGCTTCCTTCGTGCCCC (SEQ ID NO: 1463) |
| 137ORF18_5_88780146_88782265_88885645_88890401_RF | OBD159_1249 | GCCACAAAGTAAAGCAAGAAGTAGG G (SEQ ID NO: 1464) |
| 138ORF18_6_137232223_137235679_137341897_137343885_RF | OBD159_1253 | GGAAATGGTGGCGGGAAGGAGAAAT G (SEQ ID NO: 1465) |
| 139ORF180_14_106693397_106698909_106725269_106729795_RF | OBD159_1257 | CCTCCCAGTCATTTCCCTCTCACCAT (SEQ ID NO: 1466) |
| 140ORF181_5_148931403_148934917_149013571_149016721_RR | OBD159_1261 | TACTGCTGAAAACAATCCTATGGG (SEQ ID NO: 1467) |
| 141ORF183_3_45968082_45972062_46021458_46028558_RF | OBD159_1265 | CCCTCCCACTCACCAAACAACAGG (SEQ ID NO: 1468) |
| 142ORF183_8_52230322_52233827_52319467_52326208_RR | OBD159_1269 | ATTCACTTTCACTCTCAGGTGTGTCC (SEQ ID NO: 1469) |
| 143ORF186_10_89827266_89829504_89863078_89864649_RR | OBD159_1273 | CTTGACCTCTTCCTCTGCTGAAT (SEQ ID NO: 1470) |
| 144ORF186_2_198037606_198046520_198099686_198102962_RR | OBD159_1277 | GACTCTTTGTAAGCACAGAACTCAAC (SEQ ID NO: 1471) |
| 145ORF187_2_102980783_102983000_103034107_103047709_RR | OBD159_1281 | AAGGGCAGGAGAGGAATAGGGCAA AG (SEQ ID NO: 1472) |
| 146ORF187_6_157897501_157902533_158001619_158004030_RF | OBD159_1285 | TAAGCCTCCACAAGCCCCATCAT (SEQ ID NO: 1473) |
| 147ORF188_6_30104839_30106896_30143621_30146632_RR | OBD159_1289 | AAAAGTGGGACAAGAAGGAGGCAGC (SEQ ID NO: 1474) |
| 148ORF19_20_46511970_46518882_46567001_46568090_RF | OBD159_1293 | CTACCATAGCCCTTTTATCAATCCAG (SEQ ID NO: 1475) |
| 149ORF19_8_86980479_86986149_87043788_87045089_RR | OBD159_1297 | TGCTTCCTAAAACACGGCAAAGTG (SEQ ID NO: 1476) |
| 150ORF19_8_89837286_89838355_89905359_89910373_FR | OBD159_1301 | AAAGGGTCAAGAAATCAAGATAGC (SEQ ID NO: 1477) |
| 151ORF190_7_42842614_42843656_42886026_42890585_FF | OBD159_1305 | GTGCCTCCTTATCCCCTCAGTCC (SEQ ID NO: 1478) |
| 152ORF191_2_102924054_102927148_102983000_102995309_FR | OBD159_1309 | CTAAGTGTAGAAATAAATGCGAAA (SEQ ID NO: 1479) |
| 153ORF191_3_168579832_168593354_168619477_168632678_RF | OBD159_1313 | GACATTGGCAGAGGTAAATAAATA (SEQ ID NO: 1480) |
| 154ORF191_5_6223946_6226870_6298491_6302848_FR | OBD159_1317 | CTGTTCTCAGCAATGGAATCTCAGGT (SEQ ID NO: 102) |
| 155ORF192_10_12596194_12598368_12616738_12619998_RF | OBD159_1321 | GTAGCAAACCCACTTCCCTCCTGC (SEQ ID NO: 1482) |
| 156ORF193_5_90129888_90142322_90153362_90157668_RF | OBD159_1325 | GCTGTCTCCCCTGTATTGTTCTGACT (SEQ ID NO: 1483) |
| 157ORF193_6_155189636_155191926_155219095_155222285_RR | OBD159_1329 | CTTGCTTCTGGGTGCCTTTGCTCTTG (SEQ ID NO: 1484) |
| 158ORF195_20_11971793_11975460_11994892_11999282_FR | OBD159_1333 | TTAGGTCCTGGCTGAAGCAGAGGTAT (SEQ ID NO: 1485) |
| 159ORF196_1_229821816_229824593_229859020_229862315_RR | OBD159_1337 | CAGAAGGCAGCCCACCCACTGAT (SEQ ID NO: 1486) |

TABLE 2.b7-continued

| Probe | PCR-Primer1_ID | PCR_Primer1 |
|---|---|---|
| 160ORF197_1_66151966_66159635_66218811_66223865_FR | OBD159_1341 | AAACTCCTGACCTCTCACCTGCCTTG (SEQ ID NO: 1487) |
| 161ORF197_13_110131405_110134324_110146402_110150942_FR | OBD159_1345 | AGAATGGGTCTTACTTTGAAAATA (SEQ ID NO: 1488) |
| 162ORF197_15_69259199_69263452_69320948_69322275_RR | OBD159_1349 | ATCATAATGTGGTGTGGCAAGTGC (SEQ ID NO: 1489) |
| 163ORF197_4_22994756_23003981_23065929_23067873_FR | OBD159_1353 | GGAACTACAGTGTCTTCTACAGGGAC (SEQ ID NO: 1490) |
| 164ORF198_9_28270698_28275294_28314155_28333777_RF | OBD159_1357 | GAAAACCAGTCAATCCTCAAGTGTGC (SEQ ID NO: 1491) |

TABLE 2.b8

| | PCR-Primer2_ID | PCR_Primer2 | Marker | GLMNET |
|---|---|---|---|---|
| 83 | OBD159_1035 | CTGGTGAGGAAAGAGAGGGTGGG (SEQ ID NO: 1492) | OBD159_1033_1035 | -2.85E-05 |
| 84 | OBD159_1039 | GCGGGTTTGTGTCAGAAGGGTGTAAA (SEQ ID NO: 1493) | OBD159_1037_1039 | 0.001873877 |
| 85 | OBD159_1043 | TGAAATGAGCAGGTGGGAGTAGGTGG (SEQ ID NO: 96) | OBD159_1041_1043 | 0.001322182 |
| 86 | OBD159_1047 | TGTTCCTATTTCTCTCCTATTTTA (SEQ ID NO: 1495) | OBD159_1045_1047 | 0.002228021 |
| 87 | OBD159_1051 | GCAGCAGGTCCTCAGATGATGTC (SEQ ID NO: 1496) | OBD159_1049_1051 | 7.56E-05 |
| 88 | OBD159_1055 | CTGTGTGACCTTGGGCAACTTGTTA (SEQ ID NO: 1497) | OBD159_1053_1055 | 0.000339187 |
| 89 | OBD159_1059 | GGCTCTAAGATTGAGGCTGTGAT (SEQ ID NO: 1498) | OBD159_1057_1059 | 0.001793657 |
| 90 | OBD159_1063 | GAGTGGAGATGGTAGAAGAGTCTGTG (SEQ ID NO: 1499) | OBD159_1061_1063 | 0.002728633 |
| 91 | OBD159_1067 | TTCTTCCCTCAGCCATCCATTTGG (SEQ ID NO: 1500) | OBD159_1065_1067 | 0.002219464 |
| 92 | OBD159_1071 | AAGTTAGAGTTCAGTTGGAGATGC (SEQ ID NO: 1501) | OBD159_1069_1071 | 0.000915369 |
| 93 | OBD159_1075 | CATCCTTTATCTTCCCTACCCCATCA (SEQ ID NO: 1502) | OBD159_1073_1075 | 0.003263876 |
| 94 | OBD159_1079 | CCCACTCCAGTTTGTCCAGGATGC (SEQ ID NO: 1503) | OBD159_1077_1079 | 0 |
| 95 | OBD159_1083 | ACTTCTACCCTCATCCCTCTCCAT (SEQ ID NO: 1504) | OBD159_1081_1083 | 0.003860847 |
| 96 | OBD159_1087 | GGTTCAAGGTAGGAAGAGAAAAGC (SEQ ID NO: 1505) | OBD159_1085_1087 | 0.000870626 |
| 97 | OBD159_1091 | CCACTTTCTCTGATAAGGCAAACGCT (SEQ ID NO: 1506) | OBD159_1089_1091 | 0.000608575 |
| 98 | OBD159_1095 | TGTTCCTCACTATTCCAAAATGAA (SEQ ID NO: 1507) | OBD159_1093_1095 | 0.000363009 |
| 99 | OBD159_1099 | CAAAGTAGTAGGGCAAGGCAAATGAA (SEQ ID NO: 1508) | OBD159_1097_1099 | 0.000679628 |
| 100 | OBD159_1103 | GACCTGGCTACTCTTGAAACACCCAC (SEQ ID NO: 1509) | OBD159_1101_1103 | 0.001541794 |
| 101 | OBD159_1107 | CCTGAGAGGCAGCAATAACTACTGTT | OBD159_1105_1107 | 0.002451015 |

TABLE 2.b8-continued

| PCR-Primer2_ID | PCR_Primer2 | Marker | GLMNET |
|---|---|---|---|
| | (SEQ ID NO: 1510) | | |
| 102 OBD159_1111 | TCTAAGAATCCATTGCGTGTAAAAGC (SEQ ID NO: 1511) | OBD159_1109_1111 | 0.000974768 |
| 103 OBD159_1115 | AAGTAACAGAGTAAGAAGAAATAC (SEQ ID NO: 1512) | OBD159_1113_1115 | 0.001095802 |
| 104 OBD159_1119 | GTTATGAATGATGTTTGTCCCTCAAC (SEQ ID NO: 1513) | OBD159_1117_1119 | 0.001101503 |
| 105 OBD159_1123 | GGGAATGTATGCTGTTCTCAGAG (SEQ ID NO: 1514) | OBD159_1121_1123 | 0.003371624 |
| 106 OBD159_1127 | CAGACAAAGCAAAGATTTCCTAT (SEQ ID NO: 1515) | OBD159_1125_1127 | -0.000215853 |
| 107 OBD159_1131 | GCTCCAGGTCTCTTCCCAAGTGAC (SEQ ID NO: 1516) | OBD159_1129_1131 | 0.002952499 |
| 108 OBD159_1135 | GAGACCAGGAACTCAGGACCAGC (SEQ ID NO: 1517) | OBD159_1133_1135 | 0.001888614 |
| 109 OBD159_1139 | CCAACCAAATGGGAGGCAACGCC (SEQ ID NO: 1518) | OBD159_1137_1139 | 0.001218231 |
| 110 OBD159_1143 | AGGTCTCAAGCAAGGGAGCAACAT (SEQ ID NO: 1519) | OBD159_1141_1143 | 0.000217315 |
| 111 OBD159_1147 | GAGTTTCAAGTGCCCTACTGGCTGA (SEQ ID NO: 1520) | OBD159_1145_1147 | 0.000706585 |
| 112 OBD159_1151 | TGGAAAACACAGTCCCACCTCTCAGA (SEQ ID NO: 1521) | OBD159_1149_1151 | 0.001473508 |
| 113 OBD159_1155 | AATACTGGCAAGAACCCATCTACTGC (SEQ ID NO: 1522) | OBD159_1153_1155 | 0.001036966 |
| 114 OBD159_1159 | GCCTTTTATTCTGTGTGTGGCTAAGC (SEQ ID NO: 1523) | OBD159_1157_1159 | 0.002575321 |
| 115 OBD159_1163 | CAAGCACTGTCCAATAGGAAGCATAA (SEQ ID NO: 1524) | OBD159_1161_1163 | 0.00172898 |
| 116 OBD159_1167 | TCTGCCAACACCACATCATCTTGA (SEQ ID NO: 1525) | OBD159_1165_1167 | 0.000283452 |
| 117 OBD159_1171 | GTTCTGGTTTCCACCTGCTTGACTTC (SEQ ID NO: 1526) | OBD159_1169_1171 | 0.000503528 |
| 118 OBD159_1175 | ATTGTATCTTTGGTGCCAGCCCCGTG (SEQ ID NO: 1527) | OBD159_1173_1175 | 0.001624198 |
| 119 OBD159_1179 | GACTGACTCACCACCCAAGCACG (SEQ ID NO: 1528) | OBD159_1177_1179 | 0.00084099 |
| 120 OBD159_1183 | GAAGACATACACAGTAAGCCCTCTGC (SEQ ID NO: 1529) | OBD159_1181_1183 | 0.001347797 |
| 121 OBD159_1187 | TACTGGGAAGTTGCCTTAGTCCAAAT (SEQ ID NO: 1530) | OBD159_1185_1187 | 0.002383468 |
| 122 OBD159_1191 | CTATTGGGCTTAGAGTGTCTGTCT (SEQ ID NO: 1531) | OBD159_1189_1191 | 0.000213238 |
| 123 OBD159_1195 | CCTGAGGATGTGAATGCTGTAGTGAT (SEQ ID NO: 1532) | OBD159_1193_1195 | 0.001404922 |
| 124 OBD159_1199 | ACAGTTTCCTTGGAGTTGTGGAGACA (SEQ ID NO: 1533) | OBD159_1197_1199 | 0.00112924 |
| 125 OBD159_1203 | CATTCCAGCATTGGTTGGCATTTGAA (SEQ ID NO: 1534) | OBD159_1201_1203 | 0.002206091 |
| 126 OBD159_1207 | CCCATTCACCCTCCCTTGCTGGA (SEQ ID NO: 1535) | OBD159_1205_1207 | 0.000977446 |
| 127 OBD159_1211 | TCTCCAGTTGTTAGTGTTTCAATA (SEQ ID NO: 1211) | OBD159_1209_1211 | 0.001131973 |

TABLE 2.b8-continued

| PCR-Primer2_ID | PCR_Primer2 | Marker | GLMNET |
|---|---|---|---|
| | ID NO: 1536) | | |
| 128 OBD159_1215 | GATTGTATGATTTGCTGGGTTGATTG (SEQ ID NO: 1537) | OBD159_1213_1215 | 3.25E-05 |
| 129 OBD159_1219 | GAATGGTGGAAGTTTTCAGGAGCAGA (SEQ ID NO: 1538) | OBD159_1217_1219 | 0.002014272 |
| 130 OBD159_1223 | GTCACCGTCCCCAGCAAGAAAGA (SEQ ID NO: 1539) | OBD159_1221_1223 | 0.00145882 |
| 131 OBD159_1227 | CCGACTTACGGTGTCCATTATTATGC (SEQ ID NO: 1540) | OBD159_1225_1227 | 0.001130819 |
| 132 OBD159_1231 | GTGAGTGTGGGAAAGAGTGGGAAACG (SEQ ID NO: 1541) | OBD159_1229_1231 | 0.002314207 |
| 133 OBD159_1235 | GCACAGTTGGGTTATTGCCATTTTGG (SEQ ID NO: 1542) | OBD159_1233_1235 | 0.00293147 |
| 134 OBD159_1239 | GATGCTGAATGACCAGTGTGTTC (SEQ ID NO: 1543) | OBD159_1237_1239 | 0.001575474 |
| 135 OBD159_1243 | CAGGTGGGAGAGTTTCTTAGTGGGCA (SEQ ID NO: 1544) | OBD159_1241_1243 | 0.001456432 |
| 136 OBD159_1247 | GATTCAATGCTGTATCTACTTGCTGA (SEQ ID NO: 1545) | OBD159_1245_1247 | 0.001218888 |
| 137 OBD159_1251 | CACCTGGAGTCTGGCTACCGAAATCA (SEQ ID NO: 1546) | OBD159_1249_1251 | 0.001955857 |
| 138 OBD159_1255 | TCATCATCGTGGACAAGGAAAGCCTA (SEQ ID NO: 1547) | OBD159_1253_1255 | 0.000948155 |
| 139 OBD159_1259 | CCCACACTCCAAAATGAGAAAACCTC (SEQ ID NO: 1548) | OBD159_1257_1259 | 0.002138327 |
| 140 OBD159_1263 | CTTCATTGGTCCCTCCATTGACAT (SEQ ID NO: 1549) | OBD159_1261_1263 | 0.000218068 |
| 141 OBD159_1267 | GAACCTATTCCCAGTGATGCGGC (SEQ ID NO: 1550) | OBD159_1265_1267 | 0.002410178 |
| 142 OBD159_1271 | AGCAACCTCAACCGAGAATCACCCAG (SEQ ID NO: 1551) | OBD159_1269_1271 | 0.002111818 |
| 143 OBD159_1275 | CTGCTGGTGGGAATGTAATGAGTAT (SEQ ID NO: 1552) | OBD159_1273_1275 | 0.000433754 |
| 144 OBD159_1279 | TAGTTCAAGTTCTTCTCAAAAGCCCC (SEQ ID NO: 626) | OBD159_1277_1279 | 0.000676684 |
| 145 OBD159_1283 | ATAAACTGTGGTGGGCAAATGAGTGT (SEQ ID NO: 1554) | OBD159_1281_1283 | 0.000373713 |
| 146 OBD159_1287 | CCTGGGCAACGAGAGCAAAACTC (SEQ ID NO: 1555) | OBD159_1285_1287 | 0.001679245 |
| 147 OBD159_1291 | GAGTAAGGTAAAGTCCTCTGTTTCTA (SEQ ID NO: 1556) | OBD159_1289_1291 | 0.000887765 |
| 148 OBD159_1295 | CCATTCGCCATTCTTCCTTACCCAGC (SEQ ID NO: 1557) | OBD159_1293_1295 | 0.001654393 |
| 149 OBD159_1299 | GAGGAAGTATGACCAGGGCAGGG (SEQ ID NO: 1558) | OBD159_1297_1299 | 0.001435106 |
| 150 OBD159_1303 | AGTAAACCTGCCTCCTATTTGATA (SEQ ID NO: 1559) | OBD159_1301_1303 | 0.001218649 |
| 151 OBD159_1307 | CCAGGACATTCTCAGCCAAGGAG (SEQ ID NO: 1560) | OBD159_1305_1307 | 0.002161835 |
| 152 OBD159_1311 | AGGAACCTAAACTCACTTCTCAGT (SEQ ID NO: 1561) | OBD159_1309_1311 | 0.001472024 |
| 153 OBD159_1315 | CAGTCCAAAAGCCAAGAAAGCATA | OBD159_1313_1315 | 0.00228962 |

TABLE 2.b8-continued

| | PCR-Primer2_ID | PCR_Primer2 | Marker | GLMNET |
|---|---|---|---|---|
| | | (SEQ ID NO: 1562) | | |
| 154 | OBD159_1319 | CAATAACTGAATGGCTGAGTCTGAAA (SEQ ID NO: 154) | OBD159_1317_1319 | 0.000962844 |
| 155 | OBD159_1323 | CTCTTCTGTTTGTGAGGGCTGCC (SEQ ID NO: 1564) | OBD159_1321_1323 | 0.00224545 |
| 156 | OBD159_1327 | AACGAGACAGAGTTTGGATGGGTTGC (SEQ ID NO: 1565) | OBD159_1325_1327 | 0.001327211 |
| 157 | OBD159_1331 | GGTCACTTGAAGCAACCCTTTGGAAA (SEQ ID NO: 1566) | OBD159_1329_1331 | 0.002826388 |
| 158 | OBD159_1335 | GGATTGGACAGCACCATTTGCCACAA (SEQ ID NO: 1567) | OBD159_1333_1335 | 0.004203016 |
| 159 | OBD159_1339 | GCCTGCTGCGGGTGACATTTCAA (SEQ ID NO: 1568) | OBD159_1337_1339 | 0.003039318 |
| 160 | OBD159_1343 | GAGAAGACAGGAACACTGATGCTATC (SEQ ID NO: 1569) | OBD159_1341_1343 | 0.000199874 |
| 161 | OBD159_1347 | CTTTTATTTTAGATACAGTGGTGT (SEQ ID NO: 1570) | OBD159_1345_1347 | -0.000253684 |
| 162 | OBD159_1351 | GAACTCAAAGGCAAATCGGAAATGCT (SEQ ID NO: 1571) | OBD159_1349_1351 | 0.002820958 |
| 163 | OBD159_1355 | TTCAACTGGTAAGACATTCTGAGGAA (SEQ ID NO: 1572) | OBD159_1353_1355 | 0.000748968 |
| 164 | OBD159_1359 | CTCAAGTCCTCATCTGTAGAGTCTGG (SEQ ID NO: 1573) | OBD159_1357_1359 | 0 |

TABLE 2.b9

| | Gene |
|---|---|
| 83 | CFAP61; CRNKL1 A20; RIN2; rs1057519885 |
| 84 | ADRBK2 |
| 85 | FBXW7 |
| 86 | FYB; RICTOR |
| 87 | DACT2; rs1473500 |
| 88 | CCDC160; PHF6 |
| 89 | NR4A2 |
| 90 | PROX1 |
| 91 | rs11050764; rs4931251 |
| 92 | rs12586774; rs862946 |
| 93 | METTL25; TMTC2 |
| 94 | NA |
| 95 | FRK; NT5DC1; rs1933737; rs1999930; rs3822857; rs6909746; rs868943; rs9488822 |
| 96 | NA |
| 97 | ST6GALNAC3; rs12095069 |
| 98 | RFC3 |
| 99 | ANKFY1; UBE2G1 |
| 100 | MAP4K3; TMEM178A |
| 101 | OCSTAMP; SLC13A3; rs847058 |
| 102 | ADRBK2; MYO18B |
| 103 | ADRBK2 |
| 104 | FYB; RICTOR; rs1060505056 |
| 105 | GFOD1; SIRT5 |
| 106 | CNKSR3; IPCEF1; OPRM1; rs2236256; rs4869818 |
| 107 | GALNT2; rs4925506 |
| 108 | DOCK4 |
| 109 | GPR110; GPR116 |
| 110 | NA |
| 111 | WIPF3; rs850084 |
| 112 | GALNT2; rs4925506 |
| 113 | SLC39A10 |
| 114 | NA |
| 115 | NA |
| 116 | GRIN2B |
| 117 | MEIS1; rs11692361; rs7596219 |
| 118 | SLC13A3 |

TABLE 2.b9-continued

| | Gene |
|---|---|
| 119 | PRICKLE2 |
| 120 | PPA2; rs1057517679; rs1057517680; rs138215926; rs139076647; rs146013446; rs546693824; rs772083375; rs77928427 |
| 121 | rs587777363; rs7718928 |
| 122 | TPBG; rs1369867 |
| 123 | DAB1; rs527409 |
| 124 | 39692; 39692; GDF9; SHROOM1; SOWAHA |
| 125 | PIEZO2 |
| 126 | UVRAG |
| 127 | rs148431766; rs17109786 |
| 128 | COL4A1; rs11617955; rs641862; rs672601348 |
| 129 | MAP2 |
| 130 | UQCRFS1; VSTM2B |
| 131 | FRMD4B; LMOD3 |
| 132 | VAV3; rs2801219; rs345299; rs4915077 |
| 133 | RERE; rs301806; rs301807 |
| 134 | FOLH1; TRIM64C |
| 135 | EFCAB11; TDP1 |
| 136 | THRB; rs113700287; rs1158265; rs12485694; rs1505283; rs1505297; rs1505298; rs1505307; rs1868575; rs2167115; rs7610039; rs7610222; rs7622481; rs7640580; rs826230; rs826231; rs826236; rs826238; rs826240; rs862247; rs869784; rs869785; rs9310736; rs9830674 |
| 137 | MEF2C; rs1085307051; rs114694170; rs11951031; rs11955542; rs11958689; rs12515983; rs12521522; rs17558256; rs17560407; rs17560451; rs3047819; rs3850651; rs3850653; rs397514655; rs397514656; rs4521516; rs545185248; rs61104616; rs62380364; rs700585; rs797045053; rs869312698; rs876661308 |
| 138 | IFNGR1; rs13201877 |
| 139 | NA |
| 140 | SH3TC2; rs80338933; rs80338934; rs80338935; rs80338936; rs80338937; rs9687065 |
| 141 | FYCO1; XCR1 |
| 142 | ST18 |
| 143 | KIF20B |
| 144 | PLCL1 |
| 145 | NA |
| 146 | SNX9; SYNJ2 |
| 147 | TRIM31; TRIM40 |
| 148 | OCSTAMP; SLC13A3; ZNF334 |
| 149 | CNBD1; rs41486944 |
| 150 | OSGIN2 |
| 151 | C7orf25 |
| 152 | TMEM182 |
| 153 | NA |
| 154 | NA |
| 155 | CAMK1D |
| 156 | NA |
| 157 | TFB1M; TIAM2 |
| 158 | BTBD3; rs16992846 |
| 159 | GALNT2; rs4925506 |
| 160 | PDE4B; rs10454453; rs486438; rs490094; rs567279; rs6588190 |
| 161 | COL4A1; rs641862; rs672601348 |
| 162 | GLCE; PAQR5 |
| 163 | rs358231 |
| 164 | LINGO2; rs10812774; rs7357773 |

TABLE 3.A1

| | Probe | GeneLocus |
|---|---|---|
| 1 | ORF1_12_10186674_10187896_10218366_10224430_RF | GABARAPL1; KLRD1; TMEM52B |
| 2 | ORF1_12_10186674_10187896_10218366_10224430_RF | GABARAPL1; KLRD1; TMEM52B |
| 3 | ORF1_13_31073818_31075538_31104522_31106539_RF | HSPH1; TEX26 |
| 4 | ORF1_13_31073818_31075538_31104522_31106539_RF | HSPH1; TEX26 |
| 5 | ORF1_14_64424976_64426071_64470387_64473618_RF | AKAP5; MTHFD1; ZBTB25; rs34181110; rs2236225; rs2281603; rs17824591 |
| 6 | ORF1_14_64424976_64426071_64470387_64473618_RF | AKAP5; MTHFD1; ZBTB25; rs34181110; rs2236225; rs2281603; rs17824591 |
| 7 | ORF1_2_227779837_227782633_227794345_227796581_FF | rs7556897; rs4973341; rs1811711 |
| 8 | ORF1_2_227779837_227782633_227794345_227796581_FF | rs7556897; rs4973341; rs1811711 |
| 9 | ORF1_20_19898126_19900554_19917735_19921318_RR | RIN2; rs181853315 |
| 10 | ORF1_20_19898126_19900554_19917735_19921318_RR | RIN2; rs181853315 |
| 11 | ORF1_7_41740758_41745973_41778759_41782337_FF | INHBA; rs6976118 |
| 12 | ORF1_7_41740758_41745973_41778759_41782337_FF | INHBA; rs6976118 |
| 13 | ORF1_7_41782337_41783687_41811434_41814240_RR | INHBA; rs6976118 |
| 14 | ORF1_7_41782337_41783687_41811434_41814240_RR | INHBA; rs6976118 |

TABLE 3.A1-continued

| | Probe | GeneLocus |
|---|---|---|
| 15 | ORF1_8_28471461_28475878_28486639_28490494_FF | FBXO16; FZD3 |
| 16 | ORF1_8_28471461_28475878_28486639_28490494_FF | FBXO16; FZD3 |
| 17 | ORF10_10_14268505_14273692_14331424_14334008_RR | FRMD4A; rs1218412; rs12220909 |
| 18 | ORF10_10_14268505_14273692_14331424_14334008_RR | FRMD4A; rs1218412; rs12220909 |
| 19 | ORF10_11_108858787_108864679_108885482_108890206_RF | DDX10; rs10890917 |
| 20 | ORF10_11_108858787_108864679_108885482_108890206_RF | DDX10; rs10890917 |
| 21 | ORF10_13_51326485_51332663_51385952_51389062_FR | FAM124A; INTS6; SERPINE3 |
| 22 | ORF10_13_51326485_51332663_51385952_51389062_FR | FAM124A; INTS6; SERPINE3 |
| 23 | ORF10_2_39591283_39594585_39623225_39627003_RR | MAP4K3; TMEM178A |
| 24 | ORF10_2_39591283_39594585_39623225_39627003_RR | MAP4K3; TMEM178A |
| 25 | ORF10_4_16442257_16447221_16503503_16507970_RR | LDB2; rs10939673 |
| 26 | ORF10_4_16442257_16447221_16503503_16507970_RR | LDB2; rs10939673 |
| 27 | ORF10_6_149361564_149369248_149422330_149424590_FF | SUMO4; TAB2; rs267607101; rs267607100; rs1057518422; rs237025; rs2153219 |
| 28 | ORF10_6_149361564_149369248_149422330_149424590_FF | SUMO4; TAB2; rs267607101; rs267607100; rs1057518422; rs237025; rs2153219 |
| 29 | ORF10_8_10137237_10138418_10231545_10233400_RF | MSRA; rs10107815; rs73191547; rs17749155; rs2975735; rs7001567 |
| 30 | ORF10_8_10137237_10138418_10231545_10233400_RF | MSRA; rs10107815; rs73191547; rs17749155; rs2975735; rs7001567 |
| 31 | ORF10_8_93942397_93946048_93985677_93987921_FR | PDP1; rs7006531 |
| 32 | ORF10_8_93942397_93946048_93985677_93987921_FR | PDP1; rs7006531 |
| 33 | ORF100_13_45859224_45860475_45940546_45944992_RR | SIAH3; ZC3H13 |
| 34 | ORF100_13_45859224_45860475_45940546_45944992_RR | SIAH3; ZC3H13 |
| 35 | ORF102_9_28333777_28339631_28362689_28367003_FF | LINGO2; rs7851437 |
| 36 | ORF102_9_28333777_28339631_28362689_28367003_FF | LINGO2; rs7851437 |
| 37 | ORF102_9_68359355_68363452_68378236_68383399_RF | FOXD4L3; PGM5 |
| 38 | ORF102_9_68359355_68363452_68378236_68383399_RF | FOXD4L3; PGM5 |
| 39 | ORF102_X_115396192_115405592_115455128_115457577_RF | LUZP4; PLS3 |
| 40 | ORF102_X_115396192_115405592_115455128_115457577_RF | LUZP4; PLS3 |
| 41 | ORF103_18_9946347_9948516_9986308_9994472_FR | TXNDC2; VAPA; rs29067; rs29066 |
| 42 | ORF_103_18_9946347_9948516_9986308_9994472_FR | TXNDC2; VAPA; rs29067; rs29066 |
| 43 | ORF104_1_213940736_213945091_214000960_214005699_RR | PROX1; rs7529073; rs79687284; rs2075423; rs340874; rs340839; rs7541039; rs6665764; rs3767844 |
| 44 | ORF104_1_213940736_213945091_214000960_214005699_RR | PROX1; rs7529073; rs79687284; rs2075423; rs340874; rs340839; rs7541039; rs6665764; rs3767844 |
| 45 | ORF105_10_10920335_10921487_10936753_10938007_RF | rs10752212; rs62209 |
| 46 | ORF105_10_10920335_10921487_10936753_10938007_RF | rs10752212; rs62209 |
| 47 | ORF_105_14_51872356_51878662_51935246_51939339_RF | GNG2; rs8015138 |
| 48 | ORF_105_14_51872356_51878662_51935246_51939339_RF | GNG2; rs8015138 |
| 49 | ORF106_18_58215328_58217936_58260024_58262426_FR | NEDD4L; rs17064520; rs2288774 |
| 50 | ORF106_18_58215328_58217936_58260024_58262426_FR | NEDD4L; rs17064520; rs2288774 |
| 51 | ORF106_20_59933715_59935128_59974481_59977463_FR | CDH26; FAM217B; PPP1R3D; SYCP2 |
| 52 | ORF_106_20_59933715_59935128_59974481_59977463_FR | CDH26; FAM217B; PPP1R3D; SYCP2 |
| 53 | ORF_106_4_84797792_84803613_84849928_84853393_FR | CDS1; WDFY3 |
| 54 | ORF106_4_84797792_84803613_84849928_84853393_FR | CDS1; WDFY3 |
| 55 | ORF107_3_152324462_152326283_152344695_152347512_FR | MBNL1; TMEM14E; rs185894411 |
| 56 | ORF107_3_152324462_152326283_152344695_152347512_FR | MBNL1; TMEM14E; rs185894411 |
| 57 | ORF109_2_104433140_104437833_104474480_104478025_RF | rs62152284; rs12615966 |
| 58 | ORF109_2_104433140_104437833_104474480_104478025_RF | rs62152284; rs12615966 |
| 59 | ORF11_10_121564423_121570750_121595209_121596934_FF | FGFR2; rs148514974; rs10510097; rs4752569; rs3750817; rs7895676; rs10736303; rs11200014; rs2981579; rs1078806; rs2981578; rs35054928; rs2981575; rs1219648; rs1219642; rs2912774; rs2936870; rs45631563; rs2420946; rs3135724; rs2981582; rs3135718; rs755001161 |
| 60 | ORF11_10_121564423_121570750_121595209_121596934_FF | FGFR2; rs148514974; rs10510097; rs4752569; rs3750817; rs7895676; rs10736303; rs11200014; rs2981579; rs1078806; rs2981578; rs35054928; rs2981575; rs1219648; rs1219642; rs2912774; rs2936870; rs45631563; rs2420946; rs3135724; rs2981582; rs3135718; rs755001161 |
| 61 | ORF11_10_23011505_23013473_23072347_23075403_FF | ARMC3; MSRB2 |
| 62 | ORF11_10_23011505_23013473_23072347_23075403_FF | ARMC3; MSRB2 |
| 63 | ORF11_2_41846751_41848865_41954493_41957526_FF | C2orf91; rs4305317; rs6740960; rs10211025 |
| 64 | ORF11_2_41846751_41848865_41954493_41957526_FF | C2orf91; rs4305317; rs6740960; rs10211025 |
| 65 | ORF11_5_39079109_39081309_39147583_39150100_RF | FYB; RICTOR; rs1060505056 |
| 66 | ORF11_5_39079109_39081309_39147583_39150100_RF | FYB; RICTOR; rs1060505056 |
| 67 | ORF11_6_134192786_134196745_134322425_134324942_FR | SGK1; rs1009840; rs4896030; rs9493873; rs1743966 |
| 68 | ORF11_6_134192786_134196745_134322425_134324942_FR | SGK1; rs1009840; rs4896030; rs9493873; rs1743966 |
| 69 | ORF11_6_36576177_36578246_36622186_36625149_RF | SRSF3; rs7771547 |
| 70 | ORF11_6_36576177_36578246_36622186_36625149_RF | SRSF3; rs7771547 |
| 71 | ORF11_6_84775145_84786636_84804896_84812997_RR | rs77693245; rs72912698 |
| 72 | ORF11_6_84775145_84786636_84804896_84812997_RR | rs77693245; rs72912698 |
| 73 | ORF11_9_120675206_120677868_120725114_120727254_FR | MEGF9; rs7044106 |
| 74 | ORF11_9_120675206_120677868_120725114_120727254_FR | MEGF9; rs7044106 |
| 75 | ORF110_9_92403506_92407832_92438750_92441269_RF | ASPN; CENPP; OGN; OMD |
| 76 | ORF110_9_92403506_92407832_92438750_92441269_RF | ASPN; CENPP; OGN; OMD |

TABLE 3.A1-continued

| | Probe | GeneLocus |
|---|---|---|
| 77 | ORF111_1_159074759_159077481_159117264_159124296_RR | AIM2; rs855871; rs855873; rs855866; rs855867; rs2852720; rs2518564; rs2814764; rs1894043; rs2852727; rs1894044; rs2518569 |
| 78 | ORF111_1_159074759_159077481_159117264_159124296_RR | AIM2; rs855871; rs855873; rs855866; rs855867; rs2852720; rs2518564; rs2814764; rs1894043; rs2852727; rs1894044; rs2518569 |
| 79 | ORF112_10_112983990_112985695_112999906_113005525_RR | TCF7L2; rs17747324; rs34872471; rs7901695; rs4506565; rs7903146; rs4132670 |
| 80 | ORF112_10_112983990_112985695_112999906_113005525_RR | TCF7L2; rs17747324; rs34872471; rs7901695; rs4506565; rs7903146; rs4132670 |
| 81 | ORF112_2_104411249_104413918_104466236_104469082_FR | rs62152284; rs12615966 |
| 82 | ORF112_2_104411249_104413918_104466236_104469082_FR | rs62152284; rs12615966 |
| 83 | ORF112_22_26756491_26757562_26817002_26819259_FR | rs9608521; rs1894720 |
| 84 | ORF112_22_26756491_26757562_26817002_26819259_FR | rs9608521; rs1894720 |
| 85 | ORF113_21_40396097_40402350_40423687_40428489_RR | DSCAM; rs9980603 |
| 86 | ORF_113_21_40396097_40402350_40423687_40428489_RR | DSCAM; rs9980603 |
| 87 | ORF_113_5_7540900_7542383_7606244_7610178_FR | ADCY2; rs17231202; rs10512928; rs884964; rs12522444; rs11134242; rs4530734; rs12519539; rs34043481 |
| 88 | ORF113_5_7540900_7542383_7606244_7610178_FR | ADCY2; rs17231202; rs10512928; rs884964; rs12522444; rs11134242; rs4530734; rs12519539; rs34043481 |
| 89 | ORF113_7_28717278_28719857_28769795_28772438_RR | CREB5; rs56388170 |
| 90 | ORF113_7_28717278_28719857_28769795_28772438_RR | CREB5; rs56388170 |
| 91 | ORF115_2_235136683_235138232_235199086_235201324_RF | SH3BP4; rs6431360 |
| 92 | ORF115_2_235136683_235138232_235199086_235201324_RF | SH3BP4; rs6431360 |
| 93 | ORF115_9_131590628_131592768_131654389_131655808_FR | RAPGEF1; rs11243444; rs4740283 |
| 94 | ORF115_9_131590628_131592768_131654389_131655808_FR | RAPGEF1; rs11243444; rs4740283 |
| 95 | ORF117_4_16871472_16876803_16929111_16933508_FF | LDB2; rs12503223 |
| 96 | ORF117_4_16871472_16876803_16929111_16933508_FF | LDB2; rs12503223 |
| 97 | ORF117_6_115981175_115984851_116027406_116036226_FR | FRK; rs1933737; rs9488822; rs3822857; rs868943; rs6909746; rs1999930 |
| 98 | ORF117_6_115981175_115984851_116027406_116036226_FR | FRK; rs1933737; rs9488822; rs3822857; rs868943; rs6909746; rs1999930 |
| 99 | ORF117_X_11308524_11309949_11364232_11365389_RR | AMELX; ARHGAP6 |
| 100 | ORF117_X_11308524_11309949_11364232_11365389_RR | AMELX; ARHGAP6 |
| 101 | ORF118_3_58502739_58504383_58624445_58628835_FR | ACOX2; FAM107A; KCTD6; rs150832314; rs1057519329; rs11539086; rs13315591 |
| 102 | ORF118_3_58502739_58504383_58624445_58628835_FR | ACOX2; FAM107A; KCTD6; rs150832314; rs1057519329; rs11539086; rs13315591 |
| 103 | ORF_118_4_84797792_84803613_84853916_84860994_FR | CDS1; WDFY3 |
| 104 | ORF118_4_84797792_84803613_84853916_84860994_FR | CDS1; WDFY3 |
| 105 | ORF119_6_73688989_73690148_73720087_73722647_FR | CD109; SLC17A5 |
| 106 | ORF119_6_73688989_73690148_73720087_73722647_FR | CD109; SLC17A5 |
| 107 | ORF12_10_14331424_14334008_14346291_14350333_RR | FRMD4A; rs1218412 |
| 108 | ORF12_10_14331424_14334008_14346291_14350333_RR | FRMD4A; rs1218412 |
| 109 | ORF12_11_87926403_87934326_87969207_88006264_FR | rs16914161 |
| 110 | ORF12_11_87926403_87934326_87969207_88006264_FR | rs16914161 |

TABLE 3.a2

| | Probe_Count_Total | Probe_Count_Sig | HyperG_Stats |
|---|---|---|---|
| 1 | 29; 26; 59 | 2; 2; 2; 1; 2; 2 | 0.211050406; 0.22548219; 0.19032457; 0.373699919; 0.269881341; 0.261532562 |
| 2 | 29; 26; 59 | 2; 2; 2; 1; 2; 2 | 0.211050406; 0.22548219; 0.19032457; 0.373699919; 0.269881341; 0.261532562 |
| 3 | 41; 40 | 2; 2; 2; 2 | 0.26460109; 0.271883499; 0.261899069; 0.269983451 |
| 4 | 41; 40 | 2; 2; 2; 2 | 0.26460109; 0.271883499; 0.261899069; 0.269983451 |
| 5 | 37; 94; 90; NA | 1; 1; 3; 1; 3; 1; NA | 0.34481748; 0.331269672; 0.213331923; 0.072103962; 0.219233776; 0.082047788; NA |
| 6 | 37; 94; 90; NA | 1; 1; 3; 1; 3; 1; NA | 0.34481748; 0.331269672; 0.213331923; 0.072103962; 0.219233776; 0.082047788; NA |
| 7 | NA | NA | NA |
| 8 | NA | NA | NA |
| 9 | 175; NA | 4; 4; NA | 0.096861772; 0.075450093; NA |
| 10 | 175; NA | 4; 4; NA | 0.096861772; 0.075450093; NA |
| 11 | 76; NA | 2; 2; NA | 0.228521565; 0.209515033; NA |
| 12 | 76; NA | 2; 2; NA | 0.228521565; 0.209515033; NA |
| 13 | 76; NA | 2; 2; NA | 0.228521565; 0.209515033; NA |
| 14 | 76; NA | 2; 2; NA | 0.228521565; 0.209515033; NA |
| 15 | 63; 57 | 3; 3; 3; 3 | 0.216848517; 0.224771745; 0.202795213; 0.214348844 |
| 16 | 63; 57 | 3; 3; 3; 3 | 0.216848517; 0.224771745; 0.202795213; 0.214348844 |
| 17 | 107; NA | 3; 2; NA | 0.188257442; 0.10954189; NA |
| 18 | 107; NA | 3; 2; NA | 0.188257442; 0.10954189; NA |
| 19 | 32; NA | 1; 1; NA | 0.363856051; 0.35529211; NA |
| 20 | 32; NA | 1; 1; NA | 0.363856051; 0.35529211; NA |

TABLE 3.a2-continued

| | Probe_Count_Total | Probe_Count_Sig | HyperG_Stats |
|---|---|---|---|
| 21 | 40; 55; 43 | 2; 2; 1; 1; 2; 2 | 0.261899069; 0.269983451; 0.250357845; 0.226828239; 0.269116178; 0.27473038 |
| 22 | 40; 55; 43 | 2; 2; 1; 1; 2; 2 | 0.261899069; 0.269983451; 0.250357845; 0.226828239; 0.269116178; 0.27473038 |
| 23 | 21; 58 | 2; 1; 2; 1 | 0.149991246; 0.37425716; 0.271314317; 0.210195578 |
| 24 | 21; 58 | 2; 1; 2; 1 | 0.149991246; 0.37425716; 0.271314317; 0.210195578 |
| 25 | 77; NA | 2; 2; NA | 0.225457238; 0.206032338; NA |
| 26 | 77; NA | 2; 2; NA | 0.225457238; 0.206032338; NA |
| 27 | 12; 26; NA | 1; 1; 1; 2; NA | 0.302214299; 0.314913912; 0.375314357; 0.205329626; NA |
| 28 | 12; 26; NA | 1; 1; 1; 2; NA | 0.302214299; 0.314913912; 0.375314357; 0.205329626; NA |
| 29 | 115; NA | 4; 4; NA | 0.193790369; 0.18374459; NA |
| 30 | 115; NA | 4; 4; NA | 0.193790369; 0.18374459; NA |
| 31 | 38; NA | 2; 1; NA | 0.255573168; 0.325888812; NA |
| 32 | 38; NA | 2; 1; NA | 0.255573168; 0.325888812; NA |
| 33 | 56; 50 | 3; 2; 3; 3 | 0.199907871; 0.267835203; 0.179388457; 0.193973801 |
| 34 | 56; 50 | 3; 2; 3; 3 | 0.199907871; 0.267835203; 0.179388457; 0.193973801 |
| 35 | 20; NA | 6; 4; NA | 7.69e−05; 0.007618647; NA |
| 36 | 20; NA | 6; 4; NA | 7.69e−05; 0.007618647; NA |
| 37 | 17; 17 | 1; 1; 1; 1 | 0.350975055; 0.359834557; 0.350975055; 0.359834557 |
| 38 | 17; 17 | 1; 1; 1; 1 | 0.350975055; 0.359834557; 0.350975055; 0.359834557 |
| 39 | 17; 29 | 1; 1; 2; 5 | 0.350975055; 0.359834557; 0.211050406; 0.005560973 |
| 40 | 17; 29 | 1; 1; 2; 5 | 0.350975055; 0.359834557; 0.211050406; 0.005560973 |
| 41 | 51; 111; NA | 1; 1; 2; 2; NA | 0.272236181; 0.249886334; 0.12134432; 0.099229264; NA |
| 42 | 51; 111; NA | 1; 1; 2; 2; NA | 0.272236181; 0.249886334; 0.12134432; 0.099229264; NA |
| 43 | 53; NA | 1; 2; NA | 0.261255041; 0.272683217; NA |
| 44 | 53; NA | 1; 2; NA | 0.261255041; 0.272683217; NA |
| 45 | NA | NA | NA |
| 46 | NA | NA | NA |
| 47 | 36; NA | 2; 3; NA | 0.247980559; 0.12891994; NA |
| 48 | 36; NA | 2; 3; NA | 0.247980559; 0.12891994; NA |
| 49 | 33; NA | 4; 2; NA | 0.029769861; 0.246924146; NA |
| 50 | 33; NA | 4; 2; NA | 0.029769861; 0.246924146; NA |
| 51 | 17; 17; 4; 94 | 1; 1; 1; 1; 1; 1; 1; 1 | 0.350975055; 0.359834557; 0.350975055; 0.359834557; 0.138432982; 0.14804367; 0.09039159; 0.072103962 |
| 52 | 17; 17; 4; 94 | 1; 1; 1; 1; 1; 1; 1; 1 | 0.350975055; 0.359834557; 0.350975055; 0.359834557; 0.138432982; 0.14804367; 0.09039159; 0.072103962 |
| 53 | 11; 15 | 2; 2; 2; 2 | 0.058427249; 0.066177103; 0.095167761; 0.106401792 |
| 54 | 11; 15 | 2; 2; 2; 2 | 0.058427249; 0.066177103; 0.095167761; 0.106401792 |
| 55 | 27; 21; NA | 2; 1; 2; 1; NA | 0.197546356; 0.37173223; 0.149991246; 0.37425716; NA |
| 56 | 27; 21; NA | 2; 1; 2; 1; NA | 0.197546356; 0.37173223; 0.149991246; 0.37425716; NA |
| 57 | NA | NA | NA |
| 58 | NA | NA | NA |
| 59 | 190; NA | 5; 4; NA | 0.112399625; 0.054978865; NA |
| 60 | 190; NA | 5; 4; NA | 0.112399625; 0.054978865; NA |
| 61 | 95; 92 | 1; 1; 1; 1 | 0.087779635; 0.069791754; 0.095817628; 0.076933881 |
| 62 | 95; 92 | 1; 1; 1; 1 | 0.087779635; 0.069791754; 0.095817628; 0.076933881 |
| 63 | 58; NA | 1; 1; NA | 0.234279681; 0.210195578; NA |
| 64 | 58; NA | 1; 1; NA | 0.234279681; 0.210195578; NA |
| 65 | 10; 8; NA | 2; 2; 2; 2; NA | 0.049739473; 0.05651991; 0.033505489; 0.038320555; NA |
| 66 | 10; 8; NA | 2; 2; 2; 2; NA | 0.049739473; 0.05651991; 0.033505489; 0.038320555; NA |
| 67 | 108; NA | 4; 1; NA | 0.198465555; 0.045253641; NA |
| 68 | 108; NA | 4; 1; NA | 0.198465555; 0.045253641; NA |
| 69 | 27; NA | 1; 1; NA | 0.374553651; 0.37173223; NA |
| 70 | 27; NA | 1; 1; NA | 0.374553651; 0.37173223; NA |
| 71 | NA | NA | NA |
| 72 | NA | NA | NA |
| 73 | 25; NA | 1; 1; NA | 0.375519541; 0.375121431; NA |
| 74 | 25; NA | 1; 1; NA | 0.375519541; 0.375121431; NA |
| 75 | 7; 90; 9; 8 | 1; 1; 1; 1; 1; 1; 1; 1 | 0.215038813; 0.227740664; 0.101520575; 0.082047788; 0.255358235; 0.268692312; 0.236185646; 0.249326315 |
| 76 | 7; 90; 9; 8 | 1; 1; 1; 1; 1; 1; 1; 1 | 0.215038813; 0.227740664; 0.101520575; 0.082047788; 0.255358235; 0.268692312; 0.236185646; 0.249326315 |
| 77 | 58; NA | 1; 1; NA | 0.234279681; 0.210195578; NA |
| 78 | 58; NA | 1; 1; NA | 0.234279681; 0.210195578; NA |
| 79 | 28; NA | 1; 1; NA | 0.373281001; 0.369266824; NA |
| 80 | 28; NA | 1; 1; NA | 0.373281001; 0.369266824; NA |
| 81 | NA | NA | NA |
| 82 | NA | NA | NA |
| 83 | NA | NA | NA |
| 84 | NA | NA | NA |
| 85 | 42; NA | 1; 1; NA | 0.320791853; 0.303213711; NA |
| 86 | 42; NA | 1; 1; NA | 0.320791853; 0.303213711; NA |
| 87 | 90; NA | 3; 3; NA | 0.219233776; 0.208104371; NA |
| 88 | 90; NA | 3; 3; NA | 0.219233776; 0.208104371; NA |
| 89 | 54; NA | 3; 3; NA | 0.193670022; 0.206710786; NA |
| 90 | 54; NA | 3; 3; NA | 0.193670022; 0.206710786; NA |
| 91 | 79; NA | 1; 1; NA | 0.138189127; 0.115771126; NA |
| 92 | 79; NA | 1; 1; NA | 0.138189127; 0.115771126; NA |

TABLE 3.a2-continued

| | Probe_Count_Total | Probe_Count_Sig | HyperG_Stats |
|---|---|---|---|
| 93 | 65; NA | 2; 2; NA | 0.258408092; 0.245566966; NA |
| 94 | 65; NA | 2; 2; NA | 0.258408092; 0.245566966; NA |
| 95 | 77; NA | 2; 2; NA | 0.225457238; 0.206032338; NA |
| 96 | 77; NA | 2; 2; NA | 0.225457238; 0.206032338; NA |
| 97 | 28; NA | 3; 2; NA | 0.071800115; 0.219149094; NA |
| 98 | 28; NA | 3; 2; NA | 0.071800115; 0.219149094; NA |
| 99 | 33; 35 | 1; 3; 1; 3 | 0.360592644; 0.112054294; 0.353195365; 0.123360639 |
| 100 | 33; 35 | 1; 3; 1; 3 | 0.360592644; 0.112054294; 0.353195365; 0.123360639 |
| 101 | 25; 53; 12; NA | 1; 1; 1; 1; 1; 1; NA | 0.375519541; 0.375121431; 0.261255041; 0.238249082; 0.302214299; 0.314913912; NA |
| 102 | 25; 53; 12; NA | 1; 1; 1; 1; 1; 1; NA | 0.375519541; 0.375121431; 0.261255041; 0.238249082; 0.302214299; 0.314913912; NA |
| 103 | 11; 15 | 2; 2; 2; 2 | 0.058427249; 0.066177103; 0.095167761; 0.106401792 |
| 104 | 11; 15 | 2; 2; 2; 2 | 0.058427249; 0.066177103; 0.095167761; 0.106401792 |
| 105 | 34; 34 | 3;3;3;3 | 0.103367502; 0.117734198; 0.103367502; 0.117734198 |
| 106 | 34; 34 | 3; 3; 3; 3 | 0.103367502; 0.117734198; 0.103367502; 0.117734198 |
| 107 | 107; NA | 3; 2; NA | 0.188257442; 0.10954189; NA |
| 108 | 107; NA | 3; 2; NA | 0.188257442; 0.10954189; NA |
| 109 | NA | NA | NA |
| 110 | NA | NA | NA |

TABLE 3.a3

| | FDR_HyperG | Percent_Sig | logFC | AveExpr |
|---|---|---|---|---|
| 1 | 0.375519541; 0.376115439; 0.375519541; 0.376115439; 0.375519541; 0.376115439 | 6.9; 6.9; 7.69; 3.85; 3.39; 3.39 | −0.811293893 | −0.811293893 |
| 2 | 0.375519541; 0.376115439; 0.375519541; 0.376115439; 0.375519541; 0.376115439 | 6.9; 6.9; 7.69; 3.85; 3.39; 3.39 | −0.730775029 | −0.730775029 |
| 3 | 0.375519541; 0.376115439; 0.375519541; 0.376115439 | 4.88; 4.88; 5; 5 | −0.870692099 | −0.870692099 |
| 4 | 0.375519541; 0.376115439; 0.375519541; 0.376115439 | 4.88; 4.88; 5; 5 | −0.746276793 | −0.746276793 |
| 5 | 0.375519541; 0.376115439; 0.375519541; 0.376115439; 0.375519541; 0.376115439; NA | 2.7; 2.7; 3.19; 1.06; 3.33; 1.11; NA | −0.754595643 | −0.754595643 |
| 6 | 0.375519541; 0.376115439; 0.375519541; 0.376115439; 0.375519541; 0.376115439; NA | 2.7; 2.7; 3.19; 1.06; 3.33; 1.11; NA | −0.62865404 | −0.62865404 |
| 7 | NA | NA | −0.705258334 | −0.705258334 |
| 8 | NA | NA | −0.662539712 | −0.662539712 |
| 9 | 0.375519541; 0.376115439; NA | 2.29; 2.29; NA | −1.046596585 | −1.046596585 |
| 10 | 0.375519541; 0.376115439; NA | 2.29; 2.29; NA | −0.895641708 | −0.895641708 |
| 11 | 0.375519541; 0.376115439; NA | 2.63; 2.63; NA | −1.458942479 | −1.458942479 |
| 12 | 0.375519541; 0.376115439; NA | 2.63; 2.63; NA | −1.370124623 | −1.370124623 |
| 13 | 0.375519541; 0.376115439; NA | 2.63; 2.63; NA | −1.492717199 | −1.492717199 |
| 14 | 0.375519541; 0.376115439; NA | 2.63; 2.63; NA | −1.373707801 | −1.373707801 |
| 15 | 0.375519541; 0.376115439; 0.375519541; 0.376115439 | 4.76; 4.76; 5.26; 5.26 | −0.957766564 | −0.957766564 |
| 16 | 0.375519541; 0.376115439; 0.375519541; 0.376115439 | 4.76; 4.76; 5.26; 5.26 | −0.827448174 | −0.827448174 |
| 17 | 0.375519541; 0.376115439; NA | 2.8; 1.87; NA | −0.987154267 | −0.987154267 |
| 18 | 0.375519541; 0.376115439; NA | 2.8; 1.87; NA | −0.888828194 | −0.888828194 |
| 19 | 0.375519541; 0.376115439; NA | 3.12; 3.12; NA | −0.770134963 | −0.770134963 |
| 20 | 0.375519541; 0.376115439; NA | 3.12; 3.12; NA | −0.753701128 | −0.753701128 |
| 21 | 0.375519541; 0.376115439; 0.375519541; 0.376115439; 0.375519541; 0.376115439 | 5; 5; 1.82; 1.82; 4.65; 4.65 | −0.837223688 | −0.837223688 |
| 22 | 0.375519541; 0.376115439; 0.375519541; 0.376115439; 0.375519541; 0.376115439 | 5; 5; 1.82; 1.82; 4.65; 4.65 | −0.76043036 | −0.76043036 |
| 23 | 0.375519541; 0.376115439; 0.375519541; 0.376115439 | 9.52; 4.76; 3.45; 1.72 | −1.078732682 | −1.078732682 |
| 24 | 0.375519541; 0.376115439; 0.375519541; 0.376115439 | 9.52; 4.76; 3.45; 1.72 | −0.731193465 | −0.731193465 |
| 25 | 0.375519541; 0.376115439; NA | 2.6; 2.6; NA | −1.014117733 | −1.014117733 |
| 26 | 0.375519541; 0.376115439; NA | 2.6; 2.6; NA | −0.814900115 | −0.814900115 |
| 27 | 0.375519541; 0.376115439; 0.375519541; 0.376115439; NA | 8.33; 8.33; 3.85; 7.69; NA | −0.993693839 | −0.993693839 |
| 28 | 0.375519541; 0.376115439; 0.375519541; 0.376115439; NA | 8.33; 8.33; 3.85; 7.69; NA | −0.707731847 | −0.707731847 |
| 29 | 0.375519541; 0.376115439; NA | 3.48; 3.48; NA | −0.775068462 | −0.775068462 |
| 30 | 0.375519541; 0.376115439; NA | 3.48; 3.48; NA | −0.714999895 | −0.714999895 |
| 31 | 0.375519541; 0.376115439; NA | 5.26; 2.63; NA | −0.889082025 | −0.889082025 |
| 32 | 0.375519541; 0.376115439; NA | 5.26; 2.63; NA | −0.738623593 | −0.738623593 |
| 33 | 0.375519541; 0.376115439; 0.375519541; 0.376115439 | 5.36; 3.57; 6; 6 | −0.847546213 | −0.847546213 |
| 34 | 0.375519541; 0.376115439; 0.375519541; 0.376115439 | 5.36; 3.57; 6; 6 | −0.726803577 | −0.726803577 |

TABLE 3.a3-continued

| | FDR_HyperG | Percent_Sig | logFC | AveExpr |
|---|---|---|---|---|
| 35 | 0.008046243; 0.242844385; NA | 30; 20; NA | −1.041642042 | −1.041642042 |
| 36 | 0.008046243; 0.242844385; NA | 30; 20; NA | −0.76731615 | −0.76731615 |
| 37 | 0.375519541; 0.376115439; 0.375519541; 0.376115439 | 5.88; 5.88; 5.88; 5.88 | −1.450078375 | −1.450078375 |
| 38 | 0.375519541; 0.376115439; 0.375519541; 0.376115439 | 5.88; 5.88; 5.88; 5.88 | −1.426719737 | −1.426719737 |
| 39 | 0.375519541; 0.376115439; 0.375519541; 0.217379602 | 5.88; 5.88; 6.9; 17.24 | −1.169451852 | −1.169451852 |
| 40 | 0.375519541; 0.376115439; 0.375519541; 0.217379602 | 5.88; 5.88; 6.9; 17.24 | −0.841132198 | −0.841132198 |
| 41 | 0.375519541; 0.376115439; 0.375519541; 0.376115439; NA | 1.96; 1.96; 1.8; 1.8; NA | −0.862556659 | −0.862556659 |
| 42 | 0.375519541; 0.376115439; 0.375519541; 0.376115439; NA | 1.96; 1.96; 1.8; 1.8; NA | −0.825391888 | −0.825391888 |
| 43 | 0.375519541; 0.376115439; NA | 1.89; 3.77; NA | −1.461109862 | −1.461109862 |
| 44 | 0.375519541; 0.376115439; NA | 1.89; 3.77; NA | −1.08826989 | −1.08826989 |
| 45 | NA | NA | −1.24308947 | −1.24308947 |
| 46 | NA | NA | −0.97543175 | −0.97543175 |
| 47 | 0.375519541; 0.376115439; NA | 5.56; 8.33; NA | −1.555194951 | −1.555194951 |
| 48 | 0.375519541; 0.376115439; NA | 5.56; 8.33; NA | −1.27119543 | −1.27119543 |
| 49 | 0.375519541; 0.376115439; NA | 12.12; 6.06; NA | −0.812425289 | −0.812425289 |
| 50 | 0.375519541; 0.376115439; NA | 12.12; 6.06; NA | −0.807901825 | −0.807901825 |
| 51 | 0.375519541; 0.376115439; 0.375519541; 0.376115439; 0.375519541; 0.376115439; 0.375519541; 0.376115439 | 5.88; 5.88; 5.88; 5.88; 25; 25; 1.06; 1.06 | −0.817258193 | −0.817258193 |
| 52 | 0.375519541; 0.376115439; 0.375519541; 0.376115439; 0.375519541; 0.376115439; 0.375519541; 0.376115439 | 5.88; 5.88; 5.88; 5.88; 25; 25; 1.06; 1.06 | −0.769055649 | −0.769055649 |
| 53 | 0.375519541; 0.376115439; 0.375519541; 0.376115439 | 18.18; 18.18; 13.33; 13.33 | −0.838270747 | −0.838270747 |
| 54 | 0.375519541; 0.376115439; 0.375519541; 0.376115439 | 18.18; 18.18; 13.33; 13.33 | −0.82008196 | −0.82008196 |
| 55 | 0.375519541; 0.376115439; 0.375519541; 0.376115439; NA | 7.41; 3.7; 9.52; 4.76; NA | −0.904903591 | −0.904903591 |
| 56 | 0.375519541; 0.376115439; 0.375519541; 0.376115439; NA | 7.41; 3.7; 9.52; 4.76; NA | −0.718536059 | −0.718536059 |
| 57 | NA | NA | −1.272407601 | −1.272407601 |
| 58 | NA | NA | −1.194672477 | −1.194672477 |
| 59 | 0.375519541; 0.376115439; NA | 2.63; 2.11; NA | −1.438572631 | −1.438572631 |
| 60 | 0.375519541; 0.376115439; NA | 2.63; 2.11; NA | −1.083399373 | −1.083399373 |
| 61 | 0.375519541; 0.376115439; 0.375519541; 0.376115439 | 1.05; 1.05; 1.09; 1.09 | −1.032550544 | −1.032550544 |
| 62 | 0.375519541; 0.376115439; 0.375519541; 0.376115439 | 1.05; 1.05; 1.09; 1.09 | −0.8091867 | −0.8091867 |
| 63 | 0.375519541; 0.376115439; NA | 1.72; 1.72; NA | −1.064941315 | −1.064941315 |
| 64 | 0.375519541; 0.376115439; NA | 1.72; 1.72; NA | −0.800833097 | −0.800833097 |
| 65 | 0.375519541; 0.376115439; 0.375519541; 0.376115439; NA | 20; 20; 25; 25; NA | −0.725518377 | −0.725518377 |
| 66 | 0.375519541; 0.376115439; 0.375519541; 0.376115439; NA | 20; 20; 25; 25; NA | −0.628005315 | −0.628005315 |
| 67 | 0.375519541; 0.376115439; NA | 3.7; 0.93; NA | −0.926664266 | −0.926664266 |
| 68 | 0.375519541; 0.376115439; NA | 3.7; 0.93; NA | −0.875479555 | −0.875479555 |
| 69 | 0.375519541; 0.376115439; NA | 3.7; 3.7; NA | −0.954471796 | −0.954471796 |
| 70 | 0.375519541; 0.376115439; NA | 3.7; 3.7; NA | −0.77984372 | −0.77984372 |
| 71 | NA | NA | −1.079623185 | −1.079623185 |
| 72 | NA | NA | −1.007542197 | −1.007542197 |
| 73 | 0.375519541; 0.376115439; NA | 4; 4; NA | −0.911873067 | −0.911873067 |
| 74 | 0.375519541; 0.376115439; NA | 4; 4; NA | −0.833855338 | −0.833855338 |
| 75 | 0.375519541; 0.376115439; 0.375519541; 0.376115439; 0.375519541; 0.376115439; 0.375519541; 0.376115439 | 14.29; 14.29; 1.11; 1.11; 11.11; 11.11; 12.5; 12.5 | −0.961192926 | −0.961192926 |
| 76 | 0.375519541; 0.376115439; 0.375519541; 0.376115439; 0.375519541; 0.376115439; 0.375519541; 0.376115439 | 14.29; 14.29; 1.11; 1.11; 11.11; 11.11; 12.5; 12.5 | −0.948571977 | −0.948571977 |
| 77 | 0.375519541; 0.376115439; NA | 1.72; 1.72; NA | −0.920418356 | −0.920418356 |
| 78 | 0.375519541; 0.376115439; NA | 1.72; 1.72; NA | −0.81847409 | −0.81847409 |
| 79 | 0.375519541; 0.376115439; NA | 3.57; 3.57; NA | −0.905179933 | −0.905179933 |
| 80 | 0.375519541; 0.376115439; NA | 3.57; 3.57; NA | −0.779248109 | −0.779248109 |
| 81 | NA | NA | −1.338505835 | −1.338505835 |
| 82 | NA | NA | −1.207676352 | −1.207676352 |
| 83 | NA | NA | −0.921755928 | −0.921755928 |
| 84 | NA | NA | −0.775338524 | −0.775338524 |
| 85 | 0.375519541; 0.376115439; NA | 2.38; 2.38; NA | −0.746343924 | −0.746343924 |
| 86 | 0.375519541; 0.376115439; NA | 2.38; 2.38; NA | −0.746041732 | −0.746041732 |
| 87 | 0.375519541; 0.376115439; NA | 3.33; 3.33; NA | −1.055710742 | −1.055710742 |
| 88 | 0.375519541; 0.376115439; NA | 3.33; 3.33; NA | −1.011241915 | −1.011241915 |
| 89 | 0.375519541; 0.376115439; NA | 5.56; 5.56; NA | −0.874274528 | −0.874274528 |
| 90 | 0.375519541; 0.376115439; NA | 5.56; 5.56; NA | −0.855516236 | −0.855516236 |

TABLE 3.a3-continued

| | FDR_HyperG | Percent_Sig | logFC | AveExpr |
|---|---|---|---|---|
| 91 | 0.375519541; 0.376115439; NA | 1.27; 1.27; NA | −1.104484252 | −1.104484252 |
| 92 | 0.375519541; 0.376115439; NA | 1.27; 1.27; NA | −1.102912394 | −1.102912394 |
| 93 | 0.375519541; 0.376115439; NA | 3.08; 3.08; NA | −0.824921993 | −0.824921993 |
| 94 | 0.375519541; 0.376115439; NA | 3.08; 3.08; NA | −0.709988075 | −0.709988075 |
| 95 | 0.375519541; 0.376115439; NA | 2.6; 2.6; NA | −0.797761745 | −0.797761745 |
| 96 | 0.375519541; 0.376115439; NA | 2.6; 2.6; NA | −0.737588966 | −0.737588966 |
| 97 | 0.375519541; 0.376115439; NA | 10.71; 7.14; NA | −0.78873619 | −0.78873619 |
| 98 | 0.375519541; 0.376115439; NA | 10.71; 7.14; NA | −0.68221474 | −0.68221474 |
| 99 | 0.375519541; 0.376115439; 0.375519541; 0.376115439 | 3.03; 9.09; 2.86; 8.57 | −0.846146488 | −0.846146488 |
| 100 | 0.375519541; 0.376115439; 0.375519541; 0.376115439 | 3.03; 9.09; 2.86; 8.57 | −0.837515806 | −0.837515806 |
| 101 | 0.375519541; 0.376115439; 0.375519541; 0.376115439; 0.375519541; 0.376115439; NA | 4; 4; 1.89; 1.89; 8.33; 8.33; NA | −1.027739319 | −1.027739319 |
| 102 | 0.375519541; 0.376115439; 0.375519541; 0.376115439; 0.375519541; 0.376115439; NA | 4; 4; 1.89; 1.89; 8.33; 8.33; NA | −0.975106847 | −0.975106847 |
| 103 | 0.375519541; 0.376115439; 0.375519541; 0.376115439 | 18.18; 18.18; 13.33; 13.33 | −0.975818539 | −0.975818539 |
| 104 | 0.375519541; 0.376115439; 0.375519541; 0.376115439 | 18.18; 18.18; 13.33; 13.33 | −0.849468101 | −0.849468101 |
| 105 | 0.375519541; 0.376115439; 0.375519541; 0.376115439 | 8.82; 8.82; 8.82; 8.82 | −1.048873263 | −1.048873263 |
| 106 | 0.375519541; 0.376115439; 0.375519541; 0.376115439 | 8.82; 8.82; 8.82; 8.82 | −0.849272244 | −0.849272244 |
| 107 | 0.375519541; 0.376115439; NA | 2.8; 1.87; NA | −0.782559404 | −0.782559404 |
| 108 | 0.375519541; 0.376115439; NA | 2.8; 1.87; NA | −0.773997879 | −0.773997879 |
| 109 | NA | NA | −0.864606137 | −0.864606137 |
| 110 | NA | NA | −0.664595001 | −0.664595001 |

TABLE 3.a4

| | T | P. Value | adj. P. Val | B | FC | FC_1 | LS |
|---|---|---|---|---|---|---|---|
| 1 | −7.26006068 | 0.0000101 | 0.000175139 | 3.627400598 | 0.569870536 | −1.75478453 | −1 |
| 2 | −5.243995352 | 0.000210073 | 0.002457842 | 0.58020377 | 0.602580115 | −1.659530367 | −1 |
| 3 | −8.646560156 | 0.00000175 | 0.00010547 | 5.488389749 | 0.546884433 | −1.828539889 | −1 |
| 4 | −9.848792715 | 0.000000428 | 0.0000236 | 6.872121102 | 0.596140051 | −1.677458172 | −1 |
| 5 | −10.17408165 | 0.000000301 | 0.000019 | 7.228469882 | 0.592712487 | −1.687158651 | −1 |
| 6 | −7.671264242 | 0.00000595 | 0.000226232 | 4.239067799 | 0.646779546 | −1.546121868 | −1 |
| 7 | −5.452024524 | 0.000147984 | 0.001093879 | 0.852395818 | 0.613332653 | −1.630436591 | −1 |
| 8 | −3.804767457 | 0.002531086 | 0.01396214 | −1.959895955 | 0.631765162 | −1.582866642 | −1 |
| 9 | −8.278137882 | 0.00000274 | 0.00014005 | 5.030018062 | 0.484108864 | −2.065651084 | −1 |
| 10 | −7.1983049 | 0.000011 | 0.000185081 | 3.540053384 | 0.53750806 | −1.86043722 | −1 |
| 11 | −12.58608003 | 0.0000000288 | 0.00000502 | 9.582975903 | 0.363759674 | −2.749067782 | −1 |
| 12 | −9.54041302 | 0.00000062 | 0.0000553 | 6.536791786 | 0.386857829 | −2.584928943 | −1 |
| 13 | −11.1400876 | 0.000000112 | 0.0000104 | 8.22914885 | 0.355342659 | −2.814185053 | −1 |
| 14 | −10.11233895 | 0.000000332 | 0.000038 | 7.1636613 | 0.385898194 | −2.591357033 | −1 |
| 15 | −13.08345851 | 0.0000000195 | 0.00000783 | 9.958390188 | 0.514853341 | −1.942300691 | −1 |
| 16 | −7.315134124 | 0.00000936 | 0.000166812 | 3.704870236 | 0.56352512 | −1.774543788 | −1 |
| 17 | −6.392679521 | 0.0000353 | 0.000723203 | 2.414672405 | 0.504471871 | −1.982271079 | −1 |
| 18 | −7.335610294 | 0.00000911 | 0.000163566 | 3.733571229 | 0.540052589 | −1.851671522 | −1 |
| 19 | −6.38175463 | 0.0000358 | 0.0007311 | 2.398110579 | 0.586362618 | −1.705429318 | −1 |
| 20 | −5.221072971 | 0.000215417 | 0.001432348 | 0.464971511 | 0.593080101 | −1.686112886 | −1 |
| 21 | −11.90379465 | 0.0000000558 | 0.0000134 | 8.932846123 | 0.559719654 | −1.786608695 | −1 |
| 22 | −12.32092761 | 0.0000000366 | 0.00000567 | 9.346570284 | 0.59032021 | −1.693995873 | −1 |
| 23 | −8.665673296 | 0.00000166 | 0.0000551 | 5.484804121 | 0.473444532 | −2.112179847 | −1 |
| 24 | −5.202088287 | 0.000224994 | 0.002570215 | 0.509761053 | 0.60240537 | −1.660011763 | −1 |
| 25 | −9.924213715 | 0.000000394 | 0.0000223 | 6.955657597 | 0.495131029 | −2.019667406 | −1 |
| 26 | −7.794043768 | 0.00000507 | 0.00020589 | 4.402809452 | 0.568447842 | −1.759176351 | −1 |
| 27 | −7.864436798 | 0.00000452 | 0.000103636 | 4.456020198 | 0.502190332 | −1.991276884 | −1 |
| 28 | −6.522106102 | 0.0000292 | 0.000639378 | 2.609593742 | 0.61228199 | −1.633234386 | −1 |
| 29 | −11.12098192 | 0.000000118 | 0.0000205 | 8.193707101 | 0.584360893 | −1.711271256 | −1 |
| 30 | −6.581592337 | 0.0000263 | 0.000329703 | 2.639504808 | 0.609205176 | −1.641483098 | −1 |
| 31 | −5.12615141 | 0.000251908 | 0.001609552 | 0.303637682 | 0.539957579 | −1.851997338 | −1 |
| 32 | −3.91780668 | 0.002063293 | 0.012051049 | 1.753111971 | 0.599310854 | −1.668583164 | −1 |
| 33 | −9.03942288 | 0.0000011 | 0.0000782 | 5.959952938 | 0.555729136 | −1.799437773 | −1 |
| 34 | −6.399309184 | 0.0000343 | 0.000393125 | 2.363285494 | 0.604241183 | −1.654968293 | −1 |
| 35 | −5.912028873 | 0.0000716 | 0.000656333 | 1.601923755 | 0.485774262 | −2.058569336 | −1 |
| 36 | −5.116568358 | 0.000259009 | 0.002829599 | 0.365266577 | 0.587509404 | −1.702100414 | −1 |
| 37 | −13.66980287 | 0.0000000114 | 0.000003 | 10.49913688 | 0.36600154 | −2.732228938 | −1 |
| 38 | −13.52342727 | 0.0000000134 | 0.00000639 | 10.31615292 | 0.371975695 | −2.688347689 | −1 |
| 39 | −7.660963112 | 0.0000059 | 0.0001232 | 4.182282504 | 0.444590229 | −2.249262206 | −1 |
| 40 | −5.971829876 | 0.0000664 | 0.001107418 | 1.764387775 | 0.558205329 | −1.791455489 | −1 |
| 41 | −6.902093975 | 0.0000169 | 0.000446018 | 3.168293858 | 0.549977057 | −1.818257666 | −1 |
| 42 | −6.494775221 | 0.0000298 | 0.000357672 | 2.508527608 | 0.56432889 | −1.772016316 | −1 |

TABLE 3.a4-continued

| | T | P. Value | adj. P. Val | B | FC | FC_1 | LS |
|---|---|---|---|---|---|---|---|
| 43 | −10.471397 | 0.00000022 | 0.0000159 | 7.545396321 | 0.363213603 | −2.753200852 | −1 |
| 44 | −9.681451147 | 0.00000053 | 0.0000505 | 6.694430782 | 0.47032506 | −2.126189065 | −1 |
| 45 | −7.176643041 | 0.0000113 | 0.000188484 | 3.509294753 | 0.422466992 | −2.367048834 | −1 |
| 46 | −8.486463585 | 0.00000212 | 0.000119044 | 5.291167668 | 0.50858762 | −1.966229536 | −1 |
| 47 | −9.024631716 | 0.00000109 | 0.0000421 | 5.921562838 | 0.340282544 | −2.93873435 | −1 |
| 48 | −10.67589027 | 0.000000185 | 0.0000271 | 7.750500728 | 0.414316324 | −2.41361477 | −1 |
| 49 | −7.697123323 | 0.00000575 | 0.000221811 | 4.273714214 | 0.569423805 | −1.756161213 | −1 |
| 50 | −7.314755086 | 0.00000937 | 0.000166881 | 3.704338427 | 0.571211993 | −1.750663524 | −1 |
| 51 | −11.84812377 | 0.0000000588 | 0.0000136 | 8.881901597 | 0.567519476 | −1.762054067 | −1 |
| 52 | −10.5322844 | 0.000000207 | 0.0000153 | 7.609294574 | 0.586801454 | −1.704153923 | −1 |
| 53 | −6.385515137 | 0.000035 | 0.000398491 | 2.342193529 | 0.559313576 | −1.787905825 | −1 |
| 54 | −8.801749601 | 0.00000145 | 0.0000936 | 5.676747126 | 0.566409764 | −1.765506288 | −1 |
| 55 | −7.533982769 | 0.00000698 | 0.000137048 | 4.008786409 | 0.534068392 | −1.872419365 | −1 |
| 56 | −6.874524851 | 0.0000176 | 0.000458246 | 3.128433471 | 0.607713793 | −1.645511443 | −1 |
| 57 | −9.603785157 | 0.00000056 | 0.0000279 | 6.596851595 | 0.413968357 | −2.415643572 | −1 |
| 58 | −9.343873803 | 0.000000773 | 0.0000634 | 6.313680591 | 0.436885619 | −2.288928626 | −1 |
| 59 | −9.278626339 | 0.000000809 | 0.0000351 | 6.222075719 | 0.368932137 | −2.710525596 | −1 |
| 60 | −6.706262889 | 0.0000223 | 0.00053607 | 2.882875297 | 0.471915554 | −2.119023185 | −1 |
| 61 | −9.998542088 | 0.000000363 | 0.0000212 | 7.037440135 | 0.488845154 | −2.045637545 | −1 |
| 62 | −7.206054424 | 0.0000111 | 0.00033767 | 3.600886139 | 0.570703494 | −1.752223371 | −1 |
| 63 | −12.89727391 | 0.0000000219 | 0.00000432 | 9.854104892 | 0.477992102 | −2.092084777 | −1 |
| 64 | −6.778124827 | 0.0000202 | 0.000502215 | 2.988229744 | 0.57401761 | −1.742106831 | −1 |
| 65 | −6.824231864 | 0.0000185 | 0.000262098 | 3.000017863 | 0.604779701 | −1.65349465 | −1 |
| 66 | −9.589736122 | 0.000000587 | 0.0000537 | 6.592152528 | 0.647070444 | −1.545426792 | −1 |
| 67 | −6.031878393 | 0.0000605 | 0.001040599 | 1.858720478 | 0.5260733 | −1.900875792 | −1 |
| 68 | −7.013784432 | 0.0000142 | 0.000219353 | 3.276032354 | 0.545072653 | −1.834617816 | −1 |
| 69 | −8.75382475 | 0.00000149 | 0.0000516 | 5.593397511 | 0.516030486 | −1.937870005 | −1 |
| 70 | −6.08651819 | 0.0000557 | 0.000982738 | 1.944108069 | 0.582429882 | −1.716944874 | −1 |
| 71 | −7.928733975 | 0.00000426 | 0.000184468 | 4.58023745 | 0.473152389 | −2.113483992 | −1 |
| 72 | −9.46216961 | 0.000000657 | 0.0000307 | 6.434973271 | 0.497392894 | −2.010483083 | −1 |
| 73 | −9.779482829 | 0.000000461 | 0.0000247 | 6.794858778 | 0.531494598 | −1.881486668 | −1 |
| 74 | −6.917077518 | 0.0000166 | 0.000439662 | 3.189913698 | 0.561027993 | −1.782442254 | −1 |
| 75 | −5.464709038 | 0.000144995 | 0.001078085 | 0.873461456 | 0.513632029 | −1.946919084 | −1 |
| 76 | −7.262009319 | 0.0000103 | 0.00032165 | 3.679158958 | 0.518145084 | −1.929961378 | −1 |
| 77 | −6.355337644 | 0.0000366 | 0.000410618 | 2.295957012 | 0.528355784 | −1.892664052 | −1 |
| 78 | −10.36225489 | 0.000000255 | 0.0000327 | 7.427556628 | 0.567041374 | −1.763539745 | −1 |
| 79 | −9.772002141 | 0.000000465 | 0.0000248 | 6.786491279 | 0.533966103 | −1.872778054 | −1 |
| 80 | −8.067889513 | 0.00000357 | 0.000164943 | 4.761166073 | 0.582670385 | −1.716236187 | −1 |
| 81 | −9.127661293 | 0.000000962 | 0.0000392 | 6.04429851 | 0.395429981 | −2.528892718 | −1 |
| 82 | −8.991904628 | 0.00000116 | 0.0000815 | 5.903833748 | 0.432965402 | −2.309653373 | −1 |
| 83 | −6.410265384 | 0.0000338 | 0.000389213 | 2.380019174 | 0.527866155 | −1.89441962 | −1 |
| 84 | −5.020736206 | 0.000303639 | 0.00316874 | 0.202179767 | 0.584251515 | −1.711591624 | −1 |
| 85 | −5.812981356 | 0.0000835 | 0.000728651 | 1.443055458 | 0.596112312 | −1.677536228 | −1 |
| 86 | −7.190171156 | 0.0000113 | 0.000342404 | 3.578591234 | 0.596237189 | −1.677184884 | −1 |
| 87 | −11.25389492 | 0.000000104 | 0.0000189 | 8.322746423 | 0.481060169 | −2.078742044 | −1 |
| 88 | −7.726475713 | 0.00000541 | 0.000116503 | 4.270988664 | 0.49611899 | −2.015645482 | −1 |
| 89 | −6.55717777 | 0.0000272 | 0.000336554 | 2.602777858 | 0.545528121 | −1.833086071 | −1 |
| 90 | −6.597569244 | 0.0000261 | 0.000593503 | 2.72215348 | 0.552667531 | −1.809406095 | −1 |
| 91 | −7.313278127 | 0.00000939 | 0.00016713 | 3.702265997 | 0.465068699 | −2.150219963 | −1 |
| 92 | −12.42238865 | 0.0000000348 | 0.0000104 | 9.396097401 | 0.46557568 | −2.147878512 | −1 |
| 93 | −5.756993857 | 0.0000912 | 0.000775378 | 1.352639923 | 0.564512725 | −1.771439253 | −1 |
| 94 | −5.235445229 | 0.00021303 | 0.002481219 | 0.565851161 | 0.611325192 | −1.635790596 | −1 |
| 95 | −5.877218781 | 0.0000756 | 0.000680268 | 1.546247993 | 0.575240937 | −1.738402007 | −1 |
| 96 | −5.915679735 | 0.0000723 | 0.001172545 | 1.675712313 | 0.599740803 | −1.667386969 | −1 |
| 97 | −8.347567157 | 0.0000245 | 0.00007 | 5.085501187 | 0.578850947 | −1.727560445 | −1 |
| 98 | −8.010937379 | 0.00000384 | 0.000173085 | 4.687407788 | 0.623207828 | −1.604601154 | −1 |
| 99 | −6.857265046 | 0.0000177 | 0.000254107 | 3.048471278 | 0.556268575 | −1.797692778 | −1 |
| 100 | −9.479761353 | 0.000000663 | 0.0000575 | 6.468370711 | 0.559606333 | −1.786970485 | −1 |
| 101 | −10.95352241 | 0.000000135 | 0.0000117 | 8.042297446 | 0.490478119 | −2.038826936 | −1 |
| 102 | −12.3434877 | 0.0000000373 | 0.0000109 | 9.326908953 | 0.50870217 | −1.965786779 | −1 |
| 103 | −6.695483301 | 0.0000223 | 0.000295828 | 2.809737071 | 0.508451285 | −1.966756755 | −1 |
| 104 | −6.839385861 | 0.0000185 | 0.000473389 | 3.077476369 | 0.554989314 | −1.801836493 | −1 |
| 105 | −7.188458418 | 0.0000111 | 0.00018664 | 3.526079682 | 0.483345507 | −2.068913406 | −1 |
| 106 | −6.784662393 | 0.00002 | 0.000499287 | 2.99777863 | 0.555064663 | −1.801591897 | −1 |
| 107 | −8.9573592 | 0.00000117 | 0.0000441 | 5.840799072 | 0.581334565 | −1.720179842 | −1 |
| 108 | −6.46577558 | 0.0000317 | 0.000675248 | 2.525048906 | 0.584794692 | −1.710001842 | −1 |
| 109 | −11.43498382 | 0.0000000839 | 0.00000888 | 8.518555684 | 0.54919632 | −1.8208425 | −1 |
| 110 | −8.943192738 | 0.00000123 | 0.0000843 | 5.846045718 | 0.630865779 | −1.585123229 | −1 |

TABLE 3.a5

| | Loop Detected | Probe sequence 60 mer | Probe Location Chr |
|---|---|---|---|
| 1 | sAD | TCCTTGGATAGGACATTACATATCATTTTCGAGTAATATTAAAGATTCCAGGACTCACAA (SEQ ID NO: 1574) | 12 |
| 2 | mAD | TCCTTGGATAGGACATTACATATCATTTTCGAGTAATATTAAAGATTCCAGGACTCACAA (SEQ ID NO: 1574) | 12 |
| 3 | mAD | AAAGAAATTCTTAGCTCTAGATTTATCATCGAATCATGAAAAGTGAAAGTCTGAGCTTTG (SEQ ID NO: 1576) | 13 |
| 4 | sAD | AAAGAAATTCTTAGCTCTAGATTTATCATCGAATCATGAAAAGTGAAAGTCTGAGCTTTG (SEQ ID NO: 1576) | 13 |
| 5 | sAD | CCTTATTTTTTATAGTTAAGAATGTTTTTCGAGTTTTGGCTGCTTTTCTCCCCAAGTAGA (SEQ ID NO: 1578) | 14 |
| 6 | mAD | CCTTATTTTTTATAGTTAAGAATGTTTTTCGAGTTTTGGCTGCTTTTCTCCCCAAGTAGA (SEQ ID NO: 1578) | 14 |
| 7 | sAD | GCATTGTTTCTTCATTTTATTTTATTTTTCGAAGAACTGGAAGAAGAGAACCAATGGAAA (SEQ ID NO: 1580) | 2 |
| 8 | mAD | GCATTGTTTCTTCATTTTATTTTATTTTTCGAAGAACTGGAAGAAGAGAACCAATGGAAA (SEQ ID NO: 1580) | 2 |
| 9 | mAD | TTTTGAAAATATGAAAAGGAATTTCTGTTCGATATATACTGTACATCTCAAGAAATATGT (SEQ ID NO: 1582) | 20 |
| 10 | sAD | TTTTGAAAATATGAAAAGGAATTTCTGTTCGATATATACTGTACATCTCAAGAAATATGT (SEQ ID NO: 1582) | 20 |
| 11 | sAD | CTCAATCAAGGATACTTATTATTACTTCTCGAAGCCTTAAAGCTTGGAGCATTCCTGCTA (SEQ ID NO: 1584) | 7 |
| 12 | mAD | CTCAATCAAGGATACTTATTATTACTTCTCGAAGCCTTAAAGCTTGGAGCATTCCTGCTA (SEQ ID NO: 1584) | 7 |
| 13 | sAD | TTCAATTTTGGTCAATTTATTTCAACCATCGAAAGGTAGGATCTGAGATCCCACCCTAAA (SEQ ID NO: 1586) | 7 |
| 14 | mAD | TTCAATTTTGGTCAATTTATTTCAACCATCGAAAGGTAGGATCTGAGATCCCACCCTAAA (SEQ ID NO: 1586) | 7 |
| 15 | mAD | CTAAAATGAATCCTAAAGGTCTTTTTGTTCGACGCGTCTTCATTCTAGGGTTATATTGAG (SEQ ID NO: 1588) | 8 |
| 16 | sAD | CTAAAATGAATCCTAAAGGTCTTTTTGTTCGACGCGTCTTCATTCTAGGGTTATATTGAG (SEQ ID NO: 1588) | 8 |
| 17 | mAD | TATGAAGATGAATGAAAAAATAAATAAATCGAAATAAGAAACTAGGGGGAAGAAATTAAT (SEQ ID NO: 1590) | 10 |
| 18 | sAD | TATGAAGATGAATGAAAAAATAAATAAATCGAAATAAGAAACTAGGGGGAAGAAATTAAT (SEQ ID NO: 1590) | 10 |
| 19 | mAD | TTCATAGAAATGTCTTAGATAATCATTATCGAGCTCCTCAAGTTGCATATGGAAAACTTG (SEQ ID NO: 1592) | 11 |
| 20 | sAD | TTCATAGAAATGTCTTAGATAATCATTATCGAGCTCCTCAAGTTGCATATGGAAAACTTG (SEQ ID NO: 1592) | 11 |
| 21 | mAD | TTGAAACTTTACAGGAGGTGATTAAGAATCGACTGCTCTTTGAACTCCACTGTTTAAAAG (SEQ ID NO: 1594) | 13 |
| 22 | sAD | TTGAAACTTTACAGGAGGTGATTAAGAATCGACTGCTCTTTGAACTCCACTGTTTAAAAG (SEQ ID NO: 1594) | 13 |
| 23 | sAD | CATATCTGTGAATATTTTTTTAAAACCATCGATTCAGCTGGGGAAAAATGAAAATAACAA (SEQ ID NO: 1596) | 2 |
| 24 | mAD | CATATCTGTGAATATTTTTTTAAAACCATCGATTCAGCTGGGGAAAAATGAAAATAACAA (SEQ ID NO: 1596) | 2 |
| 25 | sAD | TCAAATTTCCATATTTTACTTTATCACCTCGATAAAAACAATGTTCACACTGATTTGACA (SEQ ID NO: 1598) | 4 |
| 26 | mAD | TCAAATTTCCATATTTTACTTTATCACCTCGATAAAAACAATGTTCACACTGATTTGACA | 4 |

TABLE 3.a5-continued

| Loop Detected | Probe sequence 60 mer | Probe Location Chr |
|---|---|---|
| | (SEQ ID NO: 1598) | |
| 27 sAD | ATAAAAATAAGGTGGGTAGTTTTCAACTTCGAAAAGAAAAGAAAAGAAAAGAAAACCAA (SEQ ID NO: 1600) | 6 |
| 28 mAD | ATAAAAATAAGGTGGGTAGTTTTCAACTTCGAAAAGAAAAGAAAAGAAAAGAAAACCAA (SEQ ID NO: 1600) | 6 |
| 29 mAD | AATATGAAGAAATGAAATATAAATTGACTCGACTTAAAAGCATATTTTAAAAAATTGGTT (SEQ ID NO: 1602) | 8 |
| 30 sAD | AATATGAAGAAATGAAATATAAATTGACTCGACTTAAAAGCATATTTTAAAAAATTGGTT (SEQ ID NO: 1602) | 8 |
| 31 sAD | ATGGTAAATGACTTGTATTTATTAGATATCGAATAGTCTCTGTGGTGATTITCCTCCTAG (SEQ ID NO: 1604) | 8 |
| 32 mAD | ATGGTAAATGACTTGTATTTATTAGATATCGAATAGTCTCTGTGGTGATTITCCTCCTAG (SEQ ID NO: 1604) | 8 |
| 33 mAD | GCTATTCAAATAAACATGTATTCCTCATTCGATGAGGAAAATTTCTCTTTCTAGGAGGCT (SEQ ID NO: 1606) | 13 |
| 34 sAD | GCTATTCAAATAAACATGTATTCCTCATTCGATGAGGAAAATTTCTCTTTCTAGGAGGCT (SEQ ID NO: 1606) | 13 |
| 35 sAD | GCCCACTAAATAGTAATATTAGGATCTATCGATGAGAAAGATAAAAAGGAGGAGGAGGAA (SEQ ID NO: 1608) | 9 |
| 36 mAD | GCCCACTAAATAGTAATATTAGGATCTATCGATGAGAAAGATAAAAAGGAGGAGGAGGAA (SEQ ID NO: 1608) | 9 |
| 37 sAD | GTCATCAATATAAAAATTATTAATGCAATCGACTCTTAAATAATCTGAAAGTACTACTTC (SEQ ID NO: 1610) | 9 |
| 38 mAD | GTCATCAATATAAAAATTATTAATGCAATCGACTCTTAAATAATCTGAAAGTACTACTTC (SEQ ID NO: 1610) | 9 |
| 39 sAD | AAAATAGTATATATTCACTCTAGAAAATTCGAAGCAACAGCAAAACTGTGAAATAGATCC (SEQ ID NO: 1612) | X |
| 40 mAD | AAAATAGTATATATTCACTCTAGAAAATTCGAAGCAACAGCAAAACTGTGAAATAGATCC (SEQ ID NO: 1612) | X |
| 41 mAD | ATGTAAAGAATTTAAAAATAATCAGTTGTCGAAAGTCTGTTTGGGAACAGTGAAGTGAAC (SEQ ID NO: 1614) | 18 |
| 42 sAD | ATGTAAAGAATTTAAAAATAATCAGTTGTCGAAAGTCTGTTTGGGAACAGTGAAGTGAAC (SEQ ID NO: 1614) | 18 |
| 43 sAD | TTCTTGACTAAGTTTAGATATGCAAAATTCGAAAAGATCAATAGAAATGGGCAGAAATGT (SEQ ID NO: 1616) | 1 |
| 44 mAD | TTCTTGACTAAGTTTAGATATGCAAAATTCGAAAAGATCAATAGAAATGGGCAGAAATGT (SEQ ID NO: 1616) | 1 |
| 45 sAD | ATTAGAGAAGCAAAATTCTTCTCTACTTTCGAAAAACATATTGGATTGGTTTTTTCTTCA (SEQ ID NO: 1618) | 10 |
| 46 mAD | ATTAGAGAAGCAAAATTCTTCTCTACTTTCGAAAAACATATTGGATTGGTTTTTTCTTCA (SEQ ID NO: 1618) | 10 |
| 47 sAD | GTGAAATCCATGACTTTGAAGTCATTTTTCGAGGGATTTAAGCGAAATAGATTTATATAA (SEQ ID NO: 1620) | 14 |
| 48 mAD | GTGAAATCCATGACTTTGAAGTCATTTTTCGAGGGATTTAAGCGAAATAGATTTATATAA (SEQ ID NO: 1620) | 14 |
| 49 mAD | CGTAATGTTATTTTTAAAAACGTACTTTTCGAGTATCCAATGTATTAACCACCCCTTTAT (SEQ ID NO: 1622) | 18 |
| 50 sAD | CGTAATGTTATTTTTAAAAACGTACTTTTCGAGTATCCAATGTATTAACCACCCCTTTAT (SEQ ID NO: 1622) | 18 |
| 51 mAD | ATAATGTATAACACAAAATGTAAGAAGATCGAAGTTGAGTTGGAAATGCTTGGTGCATCA (SEQ ID NO: 1624) | 20 |

TABLE 3.a5-continued

| Loop Detected | Probe sequence 60 mer | Probe Location Chr |
|---|---|---|
| 52 sAD | ATAATGTATAACACAAAATGTAAGAAGATCGAAGTTGAGTTGGAAATGCTTGGTGCATCA (SEQ ID NO: 1624) | 20 |
| 53 sAD | GATAGAAAAAAAGGAATATATTATCAACTCGAATTTCTGTCACCATTAGTCGTGAGACTT (SEQ ID NO: 1626) | 4 |
| 54 mAD | GATAGAAAAAAAGGAATATATTATCAACTCGAATTTCTGTCACCATTAGTCGTGAGACTT (SEQ ID NO: 1626) | 4 |
| 55 sAD | CTTATTTTCTGTAAACTGAAAATTAGAGTCGAAAACATACATTGTTGTGAAAGTAAAATA (SEQ ID NO: 1628) | 3 |
| 56 mAD | CTTATTTTCTGTAAACTGAAAATTAGAGTCGAAAACATACATTGTTGTGAAAGTAAAATA (SEQ ID NO: 1628) | 3 |
| 57 sAD | ATTTTACAAATGGTTTGCAAATTCTATTTCGAAACCTGAATCACAGAATTAGGCTTGACT (SEQ ID NO: 1630) | 2 |
| 58 mAD | ATTTTACAAATGGTTTGCAAATTCTATTTCGAAACCTGAATCACAGAATTAGGCTTGACT (SEQ ID NO: 1630) | 2 |
| 59 sAD | ATGTATTTTTCACAATATGAATTAAAAGTCGACTCATTTTCATCTGAAAAGCCTGTTTAG (SEQ ID NO: 1632) | 10 |
| 60 mAD | ATGTATTTTTCACAATATGAATTAAAAGTCGACTCATTTTCATCTGAAAAGCCTGTTTAG (SEQ ID NO: 1632) | 10 |
| 61 sAD | TATTTAGCTATAGTTTTTTCTCACTTTATCGAGATGATCAAAACGATCATAGCTATTTTG (SEQ ID NO: 1634) | 10 |
| 62 mAD | TATTTAGCTATAGTTTTTTCTCACTTTATCGAGATGATCAAAACGATCATAGCTATTTTG (SEQ ID NO: 1634) | 10 |
| 63 sAD | ATTTCCAGGTTAAAAAAAATAGAAGACATCGAGTAAGCTCTCCATGAATGTTGACTATTT (SEQ ID NO: 1636) | 2 |
| 64 mAD | ATTTCCAGGTTAAAAAAAATAGAAGACATCGAGTAAGCTCTCCATGAATGTTGACTATTT (SEQ ID NO: 1636) | 2 |
| 65 sAD | TAAACAAATCTAGGAGGCCATTTTTTTTCGATTTTCATAAAACATTGTTCTTATTAAGG (SEQ ID NO: 1638) | 5 |
| 66 mAD | TAAACAAATCTAGGAGGCCATTTTTTTTCGATTTTCATAAAACATTGTTCTTATTAAGG (SEQ ID NO: 1638) | 5 |
| 67 mAD | TAAGATAGAGAAATTGATTTTTAAAACTTCGATCATATGCTTAAAACTCCAGCCACAGTG (SEQ ID NO: 1640) | 6 |
| 68 sAD | TAAGATAGAGAAATTGATTTTTAAAACTTCGATCATATGCTTAAAACTCCAGCCACAGTG (SEQ ID NO: 1640) | 6 |
| 69 sAD | TTCGCTCTTGTTTTCTTTTTTATTTTTATCGAAAAATAAAAATAAAAAAGGAGTTTCTCA (SEQ ID NO: 1642) | 6 |
| 70 mAD | TTCGCTCTTGTTTTCTTTTTTATTTTTATCGAAAAATAAAAATAAAAAAGGAGTTTCTCA (SEQ ID NO: 1642) | 6 |
| 71 mAD | TGCCTTCTTTAGGTCGCTTCTGAGCGACTCGATTTATCACAGTACCAATCACCCTAACTA (SEQ ID NO: 1644) | 6 |
| 72 sAD | TGCCTTCTTTAGGTCGCTTCTGAGCGACTCGATTTATCACAGTACCAATCACCCTAACTA (SEQ ID NO: 1644) | 6 |
| 73 sAD | CACTTAGTAAGAGTTAATTGTTCATGTTTCGATAATAAGGAAATCCACTTCTAGAAGAGC (SEQ ID NO: 1646) | 9 |
| 74 mAD | CACTTAGTAAGAGTTAATTGTTCATGTTTCGATAATAAGGAAATCCACTTCTAGAAGAGC (SEQ ID NO: 1646) | 9 |
| 75 sAD | CAAACATCAATAGAAAGTTTATAAGAAGTCGAAGCAATATTTAAAAGCTTAGAGGATGTT (SEQ ID NO: 1648) | 9 |
| 76 mAD | CAAACATCAATAGAAAGTTTATAAGAAGTCGAAGCAATATTTAAAAGCTTAGAGGATGTT (SEQ ID NO: 1648) | 9 |

TABLE 3.a5-continued

| Loop Detected | Probe sequence 60 mer | Probe Location Chr |
|---|---|---|
| 77 sAD | CCCTTTAAAACTCTTAAATATATTGTATTCGACAAAAAGTTCACAAAGAATGTAGCTTAA (SEQ ID NO: 1650) | 1 |
| 78 mAD | CCCTTTAAAACTCTTAAATATATTGTATTCGACAAAAAGTTCACAAAGAATGTAGCTTAA (SEQ ID NO: 1650) | 1 |
| 79 sAD | TGTAAAGAAAACAACGGTTGTTTTCAAGTCGATTTACCTCCTGGATCTTGTTTTCTCATC (SEQ ID NO: 1652) | 10 |
| 80 mAD | TGTAAAGAAAACAACGGTTGTTTTCAAGTCGATTTACCTCCTGGATCTTGTTTTCTCATC (SEQ ID NO: 1652) | 10 |
| 81 sAD | TTTTTTTTCATTTTTATTTTCAGAAGTATCGATTGCACAGAAATCTTCACATCACATCTT (SEQ ID NO: 1654) | 2 |
| 82 mAD | TTTTTTTTCATTTTTATTTTCAGAAGTATCGATTGCACAGAAATCTTCACATCACATCTT (SEQ ID NO: 1654) | 2 |
| 83 sAD | TTAATCTACTCTCTATCTGTGTAGATTCTCGAAATAATTCATGTCATTCACTTCAAAGAC (SEQ ID NO: 1656) | 22 |
| 84 mAD | TTAATCTACTCTCTATCTGTGTAGATTCTCGAAATAATTCATGTCATTCACTTCAAAGAC (SEQ ID NO: 1656) | 22 |
| 85 sAD | ATTAAAATATAAAATGGTAAATGTCATCTCGAATTCTTTCCTCTGAGGAGGCAAGAATTG (SEQ ID NO: 1658) | 21 |
| 86 mAD | ATTAAAATATAAAATGGTAAATGTCATCTCGAATTCTTTCCTCTGAGGAGGCAAGAATTG (SEQ ID NO: 1658) | 21 |
| 87 mAD | TATTACAGAAAAAAAAAAATGGATCTCTTCGATAAAAATGTACTTCAAAAATTGGATTGG (SEQ ID NO: 1660) | 5 |
| 88 sAD | TATTACAGAAAAAAAAAAATGGATCTCTTCGATAAAAATGTACTTCAAAAATTGGATTGG (SEQ ID NO: 1660) | 5 |
| 89 sAD | TATGAAAATATAAAAGAATATAAAGAGTTCGAGATCAGATTTAAAAGACAGACAATTCCA (SEQ ID NO: 1662) | 7 |
| 90 mAD | TATGAAAATATAAAAGAATATAAAGAGTTCGAGATCAGATTTAAAAGACAGACAATTCCA (SEQ ID NO: 1662) | 7 |
| 91 sAD | CTTCTGTTTTTATGCAGATTTAATGCAGTCGATTTACTTTTGTTTTAAAACAATTGACAA (SEQ ID NO: 1664) | 2 |
| 92 mAD | CTTCTGTTTTTATGCAGATTTAATGCAGTCGATTTACTTTTGTTTTAAAACAATTGACAA (SEQ ID NO: 1664) | 2 |
| 93 sAD | TTTTAAATTTTTATTATGATTATTATTTTCGATTTATTTAAACCTGTCTCCTCACAAGAA (SEQ ID NO: 1666) | 9 |
| 94 mAD | TTTTAAATTTTTATTATGATTATTATTTTCGATTTATTTAAACCTGTCTCCTCACAAGAA (SEQ ID NO: 1666) | 9 |
| 95 sAD | AGGCTATTTCTAGAAATAAGTATTGCCATCGAGTTACTTTCCTGATTCATTGCTCTTAGG (SEQ ID NO: 1668) | 4 |
| 96 mAD | AGGCTATTTCTAGAAATAAGTATTGCCATCGAGTTACTTTCCTGATTCATTGCTCTTAGG (SEQ ID NO: 1668) | 4 |
| 97 sAD | TGTTGTGAACTTTTGAAACAAATTTGTTTCGAATCTGAGTGTATATTTCTTATCAAGTCA (SEQ ID NO: 1670) | 6 |
| 98 mAD | TGTTGTGAACTTTTGAAACAAATTTGTTTCGAATCTGAGTGTATATTTCTTATCAAGTCA (SEQ ID NO: 1670) | 6 |
| 99 sAD | TATGATGAAGGATCAAGATTCTATAACATCGAAAAACTACCTATTGAGTACTATGTTTAC (SEQ ID NO: 1672) | X |
| 100 mAD | TATGATGAAGGATCAAGATTCTATAACATCGAAAAACTACCTATTGAGTACTATGTTTAC (SEQ ID NO: 1672) | X |
| 101 sAD | CTGTGGGAAATTTCTTTCTTTTTTCTTTTTCGACCCTTTCAGTGTTCTTCCATTCTCTCTG (SEQ ID NO: 1674) | 3 |
| 102 mAD | CTGTGGGAAATTTCTTTCTTTTTTCTTTTTCGACCCTTTCAGTGTTCTTCCATTCTCTCTG (SEQ | 3 |

TABLE 3.a5-continued

| Loop Detected | Probe sequence 60 mer | Probe Location Chr |
|---|---|---|
| | ID NO: 1674) | |
| 103 sAD | GATAGAAAAAAAGGAATATATTATCAACTCGAAGGGTCCTGAATACAAAGGTAAATAAAA (SEQ ID NO: 1676) | 4 |
| 104 mAD | GATAGAAAAAAAGGAATATATTATCAACTCGAAGGGTCCTGAATACAAAGGTAAATAAAA (SEQ ID NO: 1676) | 4 |
| 105 sAD | TTTCTTGTATTTCATTATGTACATCTATTCGATGTCAGTGTCCATCAATGGATAAATGGA (SEQ ID NO: 1678) | 6 |
| 106 mAD | TTTCTTGTATTTCATTATGTACATCTATTCGATGTCAGTGTCCATCAATGGATAAATGGA (SEQ ID NO: 1678) | 6 |
| 107 sAD | ATTAATTTCTTCCCCCTAGTTTCTTATTTCGAATTATTTAGATGATTGTCTCAATATTCC (SEQ ID NO: 1680) | 10 |
| 108 mAD | ATTAATTTCTTCCCCCTAGTTTCTTATTTCGAATTATTTAGATGATTGTCTCAATATTCC (SEQ ID NO: 1680) | 10 |
| 109 sAD | GAAGTTTCAACTTGATTCTTTCTAACTTTCGATATTACTCAATTCCAGTAGAAGATCCTC (SEQ ID NO: 1682) | 11 |
| 110 mAD | GAAGTTTCAACTTGATTCTTTCTAACTTTCGATATTACTCAATTCCAGTAGAAGATCCTC (SEQ ID NO: 1682) | 11 |

TABLE 3.a6

| | Probe Location | | | | 4 kb Sequence Location | | | |
|---|---|---|---|---|---|---|---|---|
| | Start1 | End1 | Start2 | End2 | Chr | Start1 | End1 | Start2 | End2 |
| 1 | 10186674 | 10186705 | 10224399 | 10224430 | 12 | 10186674 | 10190675 | 10220429 | 10224430 |
| 2 | 10186674 | 10186705 | 10224399 | 10224430 | 12 | 10186674 | 10190675 | 10220429 | 10224430 |
| 3 | 31073818 | 31073849 | 31106508 | 31106539 | 13 | 31073818 | 31077819 | 31102538 | 31106539 |
| 4 | 31073818 | 31073849 | 31106508 | 31106539 | 13 | 31073818 | 31077819 | 31102538 | 31106539 |
| 5 | 64424976 | 64425007 | 64473587 | 64473618 | 14 | 64424976 | 64428977 | 64469617 | 64473618 |
| 6 | 64424976 | 64425007 | 64473587 | 64473618 | 14 | 64424976 | 64428977 | 64469617 | 64473618 |
| 7 | 227782602 | 227782633 | 227796550 | 227796581 | 2 | 227778632 | 227782633 | 227792580 | 227796581 |
| 8 | 227782602 | 227782633 | 227796550 | 227796581 | 2 | 227778632 | 227782633 | 227792580 | 227796581 |
| 9 | 19898126 | 19898157 | 19917735 | 19917766 | 20 | 19898126 | 19902127 | 19917735 | 19921736 |
| 10 | 19898126 | 19898157 | 19917735 | 19917766 | 20 | 19898126 | 19902127 | 19917735 | 19921736 |
| 11 | 41745942 | 41745973 | 41782306 | 41782337 | 7 | 41741972 | 41745973 | 41778336 | 41782337 |
| 12 | 41745942 | 41745973 | 41782306 | 41782337 | 7 | 41741972 | 41745973 | 41778336 | 41782337 |
| 13 | 41782337 | 41782368 | 41811434 | 41811465 | 7 | 41782337 | 41786338 | 41811434 | 41815435 |
| 14 | 41782337 | 41782368 | 41811434 | 41811465 | 7 | 41782337 | 41786338 | 41811434 | 41815435 |
| 15 | 28475847 | 28475878 | 28490463 | 28490494 | 8 | 28471877 | 28475878 | 28486493 | 28490494 |
| 16 | 28475847 | 28475878 | 28490463 | 28490494 | 8 | 28471877 | 28475878 | 28486493 | 28490494 |
| 17 | 14268505 | 14268536 | 14331424 | 14331455 | 10 | 14268505 | 14272506 | 14331424 | 14335425 |
| 18 | 14268505 | 14268536 | 14331424 | 14331455 | 10 | 14268505 | 14272506 | 14331424 | 14335425 |
| 19 | 108858787 | 108858818 | 108890175 | 108890206 | 11 | 108858787 | 108862788 | 108886205 | 108890206 |
| 20 | 108858787 | 108858818 | 108890175 | 108890206 | 11 | 108858787 | 108862788 | 108886205 | 108890206 |
| 21 | 51332632 | 51332663 | 51385952 | 51385983 | 13 | 51328662 | 51332663 | 51385952 | 51389953 |
| 22 | 51332632 | 51332663 | 51385952 | 51385983 | 13 | 51328662 | 51332663 | 51385952 | 51389953 |
| 23 | 39591283 | 39591314 | 39623225 | 39623256 | 2 | 39591283 | 39595284 | 39623225 | 39627226 |
| 24 | 39591283 | 39591314 | 39623225 | 39623256 | 2 | 39591283 | 39595284 | 39623225 | 39627226 |
| 25 | 16442257 | 16442288 | 16503503 | 16503534 | 4 | 16442257 | 16446258 | 16503503 | 16507504 |
| 26 | 16442257 | 16442288 | 16503503 | 16503534 | 4 | 16442257 | 16446258 | 16503503 | 16507504 |
| 27 | 149369217 | 149369248 | 149424559 | 149424590 | 6 | 149365247 | 149369248 | 149420589 | 149424590 |
| 28 | 149369217 | 149369248 | 149424559 | 149424590 | 6 | 149365247 | 149369248 | 149420589 | 149424590 |
| 29 | 10137237 | 10137268 | 10233369 | 10233400 | 8 | 10137237 | 10141238 | 10229399 | 10233400 |
| 30 | 10137237 | 10137268 | 10233369 | 10233400 | 8 | 10137237 | 10141238 | 10229399 | 10233400 |
| 31 | 93946017 | 93946048 | 93985677 | 93985708 | 8 | 93942047 | 93946048 | 93985677 | 93989678 |
| 32 | 93946017 | 93946048 | 93985677 | 93985708 | 8 | 93942047 | 93946048 | 93985677 | 93989678 |
| 33 | 45859224 | 45859255 | 45940546 | 45940577 | 13 | 45859224 | 45863225 | 45940546 | 45944547 |
| 34 | 45859224 | 45859255 | 45940546 | 45940577 | 13 | 45859224 | 45863225 | 45940546 | 45944547 |
| 35 | 28339600 | 28339631 | 28366972 | 28367003 | 9 | 28335630 | 28339631 | 28363002 | 28367003 |
| 36 | 28339600 | 28339631 | 28366972 | 28367003 | 9 | 28335630 | 28339631 | 28363002 | 28367003 |
| 37 | 68359355 | 68359386 | 68383368 | 68383399 | 9 | 68359355 | 68363356 | 68379398 | 68383399 |
| 38 | 68359355 | 68359386 | 68383368 | 68383399 | 9 | 68359355 | 68363356 | 68379398 | 68383399 |
| 39 | 115396192 | 115396223 | 115457546 | 115457577 | X | 115396192 | 115400193 | 115453576 | 115457577 |
| 40 | 115396192 | 115396223 | 115457546 | 115457577 | X | 115396192 | 115400193 | 115453576 | 115457577 |
| 41 | 9948485 | 9948516 | 9986308 | 9986339 | 18 | 9944515 | 9948516 | 9986308 | 9990309 |

TABLE 3.a6-continued

| | Probe Location | | | | 4 kb Sequence Location | | | |
|---|---|---|---|---|---|---|---|---|
| | Start1 | End1 | Start2 | End2 | Chr | Start1 | End1 | Start2 | End2 |
| 42 | 9948485 | 9948516 | 9986308 | 9986339 | 18 | 9944515 | 9948516 | 9986308 | 9990309 |
| 43 | 213940736 | 213940767 | 214000960 | 214000991 | 1 | 213940736 | 213944737 | 214000960 | 214004961 |
| 44 | 213940736 | 213940767 | 214000960 | 214000991 | 1 | 213940736 | 213944737 | 214000960 | 214004961 |
| 45 | 10920335 | 10920366 | 10937976 | 10938007 | 10 | 10920335 | 10924336 | 10934006 | 10938007 |
| 46 | 10920335 | 10920366 | 10937976 | 10938007 | 10 | 10920335 | 10924336 | 10934006 | 10938007 |
| 47 | 51872356 | 51872387 | 51939308 | 51939339 | 14 | 51872356 | 51876357 | 51935338 | 51939339 |
| 48 | 51872356 | 51872387 | 51939308 | 51939339 | 14 | 51872356 | 51876357 | 51935338 | 51939339 |
| 49 | 58217905 | 58217936 | 58260024 | 58260055 | 18 | 58213935 | 58217936 | 58260024 | 58264025 |
| 50 | 58217905 | 58217936 | 58260024 | 58260055 | 18 | 58213935 | 58217936 | 58260024 | 58264025 |
| 51 | 59935097 | 59935128 | 59974481 | 59974512 | 20 | 59931127 | 59935128 | 59974481 | 59978482 |
| 52 | 59935097 | 59935128 | 59974481 | 59974512 | 20 | 59931127 | 59935128 | 59974481 | 59978482 |
| 53 | 84803582 | 84803613 | 84849928 | 84849959 | 4 | 84799612 | 84803613 | 84849928 | 84853929 |
| 54 | 84803582 | 84803613 | 84849928 | 84849959 | 4 | 84799612 | 84803613 | 84849928 | 84853929 |
| 55 | 152326252 | 152326283 | 152344695 | 152344726 | 3 | 152322282 | 152326283 | 152344695 | 152348696 |
| 56 | 152326252 | 152326283 | 152344695 | 152344726 | 3 | 152322282 | 152326283 | 152344695 | 152348696 |
| 57 | 104433140 | 104433171 | 104477994 | 104478025 | 2 | 104433140 | 104437141 | 104474024 | 104478025 |
| 58 | 104433140 | 104433171 | 104477994 | 104478025 | 2 | 104433140 | 104437141 | 104474024 | 104478025 |
| 59 | 121570719 | 121570750 | 121596903 | 121596934 | 10 | 121566749 | 121570750 | 121592933 | 121596934 |
| 60 | 121570719 | 121570750 | 121596903 | 121596934 | 10 | 121566749 | 121570750 | 121592933 | 121596934 |
| 61 | 23013442 | 23013473 | 23075372 | 23075403 | 10 | 23009472 | 23013473 | 23071402 | 23075403 |
| 62 | 23013442 | 23013473 | 23075372 | 23075403 | 10 | 23009472 | 23013473 | 23071402 | 23075403 |
| 63 | 41848834 | 41848865 | 41957495 | 41957526 | 2 | 41844864 | 41848865 | 41953525 | 41957526 |
| 64 | 41848834 | 41848865 | 41957495 | 41957526 | 2 | 41844864 | 41848865 | 41953525 | 41957526 |
| 65 | 39079109 | 39079140 | 39150069 | 39150100 | 5 | 39079109 | 39083110 | 39146099 | 39150100 |
| 66 | 39079109 | 39079140 | 39150069 | 39150100 | 5 | 39079109 | 39083110 | 39146099 | 39150100 |
| 67 | 134196714 | 134196745 | 134322425 | 134322456 | 6 | 134192744 | 134196745 | 134322425 | 134326426 |
| 68 | 134196714 | 134196745 | 134322425 | 134322456 | 6 | 134192744 | 134196745 | 134322425 | 134326426 |
| 69 | 36576177 | 36576208 | 36625118 | 36625149 | 6 | 36576177 | 36580178 | 36621148 | 36625149 |
| 70 | 36576177 | 36576208 | 36625118 | 36625149 | 6 | 36576177 | 36580178 | 36621148 | 36625149 |
| 71 | 84775145 | 84775176 | 84804896 | 84804927 | 6 | 84775145 | 84779146 | 84804896 | 84808897 |
| 72 | 84775145 | 84775176 | 84804896 | 84804927 | 6 | 84775145 | 84779146 | 84804896 | 84808897 |
| 73 | 120677837 | 120677868 | 120725114 | 120725145 | 9 | 120673867 | 120677868 | 120725114 | 120729115 |
| 74 | 120677837 | 120677868 | 120725114 | 120725145 | 9 | 120673867 | 120677868 | 120725114 | 120729115 |
| 75 | 92403506 | 92403537 | 92441238 | 92441269 | 9 | 92403506 | 92407507 | 92437268 | 92441269 |
| 76 | 92403506 | 92403537 | 92441238 | 92441269 | 9 | 92403506 | 92407507 | 92437268 | 92441269 |
| 77 | 159074759 | 159074790 | 159117264 | 159117295 | 1 | 159074759 | 159078760 | 159117264 | 159121265 |
| 78 | 159074759 | 159074790 | 159117264 | 159117295 | 1 | 159074759 | 159078760 | 159117264 | 159121265 |
| 79 | 112983990 | 112984021 | 112999906 | 112999937 | 10 | 112983990 | 112987991 | 112999906 | 113003907 |
| 80 | 112983990 | 112984021 | 112999906 | 112999937 | 10 | 112983990 | 112987991 | 112999906 | 113003907 |
| 81 | 104413887 | 104413918 | 104466236 | 104466267 | 2 | 104409917 | 104413918 | 104466236 | 104470237 |
| 82 | 104413887 | 104413918 | 104466236 | 104466267 | 2 | 104409917 | 104413918 | 104466236 | 104470237 |
| 83 | 26757531 | 26757562 | 26817002 | 26817033 | 22 | 26753561 | 26757562 | 26817002 | 26821003 |
| 84 | 26757531 | 26757562 | 26817002 | 26817033 | 22 | 26753561 | 26757562 | 26817002 | 26821003 |
| 85 | 40396097 | 40396128 | 40423687 | 40423718 | 21 | 40396097 | 40400098 | 40423687 | 40427688 |
| 86 | 40396097 | 40396128 | 40423687 | 40423718 | 21 | 40396097 | 40400098 | 40423687 | 40427688 |
| 87 | 7542352 | 7542383 | 7606244 | 7606275 | 5 | 7538382 | 7542383 | 7606244 | 7610245 |
| 88 | 7542352 | 7542383 | 7606244 | 7606275 | 5 | 7538382 | 7542383 | 7606244 | 7610245 |
| 89 | 28717278 | 28717309 | 28769795 | 28769826 | 7 | 28717278 | 28721279 | 28769795 | 28773796 |
| 90 | 28717278 | 28717309 | 28769795 | 28769826 | 7 | 28717278 | 28721279 | 28769795 | 28773796 |
| 91 | 235136683 | 235136714 | 235201293 | 235201324 | 2 | 235136683 | 235140684 | 235197323 | 235201324 |
| 92 | 235136683 | 235136714 | 235201293 | 235201324 | 2 | 235136683 | 235140684 | 235197323 | 235201324 |
| 93 | 131592737 | 131592768 | 131654389 | 131654420 | 9 | 131588767 | 131592768 | 131654389 | 131658390 |
| 94 | 131592737 | 131592768 | 131654389 | 131654420 | 9 | 131588767 | 131592768 | 131654389 | 131658390 |
| 95 | 16876772 | 16876803 | 16933477 | 16933508 | 4 | 16872802 | 16876803 | 16929507 | 16933508 |
| 96 | 16876772 | 16876803 | 16933477 | 16933508 | 4 | 16872802 | 16876803 | 16929507 | 16933508 |
| 97 | 115984820 | 115984851 | 116027406 | 116027437 | 6 | 115980850 | 115984851 | 116027406 | 116031407 |
| 98 | 115984820 | 115984851 | 116027406 | 116027437 | 6 | 115980850 | 115984851 | 116027406 | 116031407 |
| 99 | 11308524 | 11308555 | 11364232 | 11364263 | X | 11308524 | 11312525 | 11364232 | 11368233 |
| 100 | 11308524 | 11308555 | 11364232 | 11364263 | X | 11308524 | 11312525 | 11364232 | 11368233 |
| 101 | 58504352 | 58504383 | 58624445 | 58624476 | 3 | 58500382 | 58504383 | 58624445 | 58628446 |
| 102 | 58504352 | 58504383 | 58624445 | 58624476 | 3 | 58500382 | 58504383 | 58624445 | 58628446 |
| 103 | 84803582 | 84803613 | 84853916 | 84853947 | 4 | 84799612 | 84803613 | 84853916 | 84857917 |
| 104 | 84803582 | 84803613 | 84853916 | 84853947 | 4 | 84799612 | 84803613 | 84853916 | 84857917 |
| 105 | 73690117 | 73690148 | 73720087 | 73720118 | 6 | 73686147 | 73690148 | 73720087 | 73724088 |
| 106 | 73690117 | 73690148 | 73720087 | 73720118 | 6 | 73686147 | 73690148 | 73720087 | 73724088 |
| 107 | 14331424 | 14331455 | 14346291 | 14346322 | 10 | 14331424 | 14335425 | 14346291 | 14350292 |
| 108 | 14331424 | 14331455 | 14346291 | 14346322 | 10 | 14331424 | 14335425 | 14346291 | 14350292 |
| 109 | 87934295 | 87934326 | 87969207 | 87969238 | 11 | 87930325 | 87934326 | 87969207 | 87973208 |
| 110 | 87934295 | 87934326 | 87969207 | 87969238 | 11 | 87930325 | 87934326 | 87969207 | 87973208 |

TABLE 3.a7

| | Probe | PCR-Primer1_ID | PCR_Primer1 |
|---|---|---|---|
| 1 | ORF1_12_10186674_10187896_10218366_10224430_RF | OBD159_1361 | GCTGTGTCTCTCCCAGGTAGGCT (SEQ ID NO: 1684) |
| 2 | ORF1_12_10186674_10187896_10218366_10224430_RF | OBD159_1361 | GCTGTGTCTCTCCCAGGTAGGCT (SEQ ID NO: 1684) |
| 3 | ORF1_13_31073818_31075538_31104522_31106539_RF | OBD159_1365 | CTGCTTCCACGGGCATAACCCAT (SEQ ID NO: 1686) |
| 4 | ORF1_13_31073818_31075538_31104522_31106539_RF | OBD159_1365 | CTGCTTCCACGGGCATAACCCAT (SEQ ID NO: 1686) |
| 5 | ORF1_14_64424976_64426071_64470387_64473618_RF | OBD159_1369 | CATCCATACATTTCTAACTTCATC (SEQ ID NO: 1688) |
| 6 | ORF1_14_64424976_64426071_64470387_64473618_RF | OBD159_1369 | CATCCATACATTTCTAACTTCATC (SEQ ID NO: 1688) |
| 7 | ORF1_2_227779837_227782633_227794345_227796581_FF | OBD159_1373 | GGATGTCCAAGACTCTGCTGCTG (SEQ ID NO: 1690) |
| 8 | ORF1_2_227779837_227782633_227794345_227796581_FF | OBD159_1373 | GGATGTCCAAGACTCTGCTGCTG (SEQ ID NO: 1690) |
| 9 | ORF1_20_19898126_19900554_19917735_19921318_RR | OBD159_1377 | AGAAGTCCCCTGGCGAAGATGAGCA T (SEQ ID NO: 1692) |
| 10 | ORF1_20_19898126_19900554_19917735_19921318_RR | OBD159_1377 | AGAAGTCCCCTGGCGAAGATGAGCA T (SEQ ID NO: 1692) |
| 11 | ORF1_7_41740758_41745973_41778759_41782337_FF | OBD159_1381 | GGCTACTCCACAGGCAGAGCAGC (SEQ ID NO: 1694) |
| 12 | ORF1_7_41740758_41745973_41778759_41782337_FF | OBD159_1381 | GGCTACTCCACAGGCAGAGCAGC (SEQ ID NO: 1694) |
| 13 | ORF1_7_41782337_41783687_41811434_41814240_RR | OBD159_1385 | CTTCATCTAAACTTCACAGGCAAAG (SEQ ID NO: 1696) |
| 14 | ORF1_7_41782337_41783687_41811434_41814240_RR | OBD159_1385 | CTTCATCTAAACTTCACAGGCAAAG (SEQ ID NO: 1696) |
| 15 | ORF1_8_28471461_28475878_28486639_28490494_FF | OBD159_1389 | GTTCACGCTTCACTTAGACCTTACAG (SEQ ID NO: 1698) |
| 16 | ORF1_8_28471461_28475878_28486639_28490494_FF | OBD159_1389 | GTTCACGCTTCACTTAGACCTTACAG (SEQ ID NO: 1698) |
| 17 | ORF10_10_14268505_14273692_14331424_14334008_RR | OBD159_1393 | AGTCCTTGGCAGGTAGGTAGCAT (SEQ ID NO: 1700) |
| 18 | ORF10_10_14268505_14273692_14331424_14334008_RR | OBD159_1393 | AGTCCTTGGCAGGTAGGTAGCAT (SEQ ID NO: 1700) |
| 19 | ORF10_11_108858787_108864679_108885482_108890206_RF | OBD159_1397 | GTATTTGGTAGTTTTACTGTGTCTCC (SEQ ID NO: 1702) |
| 20 | ORF10_11_108858787_108864679_108885482_108890206_RF | OBD159_1397 | GTATTTGGTAGTTTTACTGTGTCTCC (SEQ ID NO: 1702) |
| 21 | ORF10_13_51326485_51332663_51385952_51389062_FR | OBD159_1401 | GTCCCCAGCATTTGTGATGTCCCCAA (SEQ ID NO: 1704) |
| 22 | ORF10_13_51326485_51332663_51385952_51389062_FR | OBD159_1401 | GTCCCCAGCATTTGTGATGTCCCCAA (SEQ ID NO: 1704) |
| 23 | ORF10_2_39591283_39594585_39623225_39627003_RR | OBD159_1405 | GGAGCAGGTTTATGGCTTCCAGG (SEQ ID NO: 1706) |
| 24 | ORF10_2_39591283_39594585_39623225_39627003_RR | OBD159_1405 | GGAGCAGGTTTATGGCTTCCAGG (SEQ ID NO: 1706) |
| 25 | ORF10_4_16442257_16447221_16503503_16507970_RR | OBD159_1409 | GCACGATTACCCCTTTATTCCAGACT (SEQ ID NO: 1708) |
| 26 | ORF10_4_16442257_16447221_16503503_16507970_RR | OBD159_1409 | GCACGATTACCCCTTTATTCCAGACT (SEQ ID NO: 1708) |

TABLE 3.a7-continued

| | Probe | PCR-Primer1_ID | PCR_Primer1 |
|---|---|---|---|
| 27 | ORF10_6_149361564_149369248_149422330_149424590_FF | OBD159_1413 | TTATTGAGCACTGAGGAGTTCTAT (SEQ ID NO: 1710) |
| 28 | ORF10_6_149361564_149369248_149422330_149424590_FF | OBD159_1413 | TTATTGAGCACTGAGGAGTTCTAT (SEQ ID NO: 1710) |
| 29 | ORF10_8_10137237_10138418_10231545_10233400_RF | OBD159_1417 | GCTTCTCTCTTCTTGCCTTCTGCCCA (SEQ ID NO: 1712) |
| 30 | ORF10_8_10137237_10138418_10231545_10233400_RF | OBD159_1417 | GCTTCTCTCTTCTTGCCTTCTGCCCA (SEQ ID NO: 1712) |
| 31 | ORF10_8_93942397_93946048_93985677_93987921_FR | OBD159_1421 | GCCCTCTTAGATTGATGCCAGAAGTA (SEQ ID NO: 1714) |
| 32 | ORF10_8_93942397_93946048_93985677_93987921_FR | OBD159_1421 | GCCCTCTTAGATTGATGCCAGAAGTA (SEQ ID NO: 1714) |
| 33 | ORF100_13_45859224_45860475_45940546_45944992_RR | OBD159_1425 | CTGCCCTCTTCCTTTCCCTCCTGTAT (SEQ ID NO: 1716) |
| 34 | ORF100_13_45859224_45860475_45940546_45944992_RR | OBD159_1425 | CTGCCCTCTTCCTTTCCCTCCTGTAT (SEQ ID NO: 1716) |
| 35 | ORF102_9_28333777_28339631_28362689_28367003_FF | OBD159_1429 | GCCTAAGTCCAGTAGTATGGTGGCTG (SEQ ID NO: 1204) |
| 36 | ORF102_9_28333777_28339631_28362689_28367003_FF | OBD159_1429 | GCCTAAGTCCAGTAGTATGGTGGCTG (SEQ ID NO: 1204) |
| 37 | ORF102_9_68359355_68363452_68378236_68383399_RF | OBD159_1433 | GGTGCTACACTCTAAGGCAGCGT (SEQ ID NO: 1720) |
| 38 | ORF102_9_68359355_68363452_68378236_68383399_RF | OBD159_1433 | GGTGCTACACTCTAAGGCAGCGT (SEQ ID NO: 1720) |
| 39 | ORF102_X_115396192_115405592_115455128_115457577_RF | OBD159_1437 | CCCTCAACACTGCTCCTCCAAGA (SEQ ID NO: 1722) |
| 40 | ORF102_X_115396192_115405592_115455128_115457577_RF | OBD159_1437 | CCCTCAACACTGCTCCTCCAAGA (SEQ ID NO: 1722) |
| 41 | ORF103_18_9946347_9948516_9986308_9994472_FR | OBD159_1441 | TTTGGCAAGGCATAGAATAGAATA (SEQ ID NO: 86) |
| 42 | ORF103_18_9946347_9948516_9986308_9994472_FR | OBD159_1441 | TTTGGCAAGGCATAGAATAGAATA (SEQ ID NO: 86) |
| 43 | ORF104_1_213940736_213945091_214000960_214005699_RR | OBD159_1445 | TAAAGACAGGCTTGTGCCAGAAAT (SEQ ID NO: 1726) |
| 44 | ORF104_1_213940736_213945091_214000960_214005699_RR | OBD159_1445 | TAAAGACAGGCTTGTGCCAGAAAT (SEQ ID NO: 1726) |
| 45 | ORF105_10_10920335_10921487_10936753_10938007_RF | OBD159_1449 | GGAGGGAGGGAAAGAGGGACTATG AA (SEQ ID NO: 1728) |
| 46 | ORF105_10_10920335_10921487_10936753_10938007_RF | OBD159_1449 | GGAGGGAGGGAAAGAGGGACTATG AA (SEQ ID NO: 1728) |
| 47 | ORF105_14_51872356_51878662_51935246_51939339_RF | OBD159_1453 | TTTTCCGTGGAGTGAACAAAGCCCA (SEQ ID NO: 1730) |
| 48 | ORF105_14_51872356_51878662_51935246_51939339_RF | OBD159_1453 | TTTTCCGTGGAGTGAACAAAGCCCA (SEQ ID NO: 1730) |
| 49 | ORF106_18_58215328_58217936_58260024_58262426_FR | OBD159_1457 | TGTAGAGCCAAATAGCCACAGGGAT A (SEQ ID NO: 966) |
| 50 | ORF106_18_58215328_58217936_58260024_58262426_FR | OBD159_1457 | TGTAGAGCCAAATAGCCACAGGGAT A (SEQ ID NO: 966) |
| 51 | ORF_106_20_59933715_59935128_59974481_59977463_FR | OBD159_1461 | CTCAGTIGTGGACCAGAGCAGAT (SEQ ID NO: 1734) |
| 52 | ORF106_20_59933715_59935128_59974481_59977463_FR | OBD159_1461 | CTCAGTIGTGGACCAGAGCAGAT |

TABLE 3.a7-continued

| Probe | PCR-Primer1_ID | PCR_Primer1 |
|---|---|---|
| | | (SEQ ID NO: 1734) |
| 53 ORF_106_4_84797792_84803613_84849928_84853393_FR | OBD159_1465 | ATGGCTCCAGGATGAATGATGACTGC (SEQ ID NO: 1736) |
| 54 ORF_106_4_84797792_84803613_84849928_84853393_FR | OBD159_1465 | ATGGCTCCAGGATGAATGATGACTGC (SEQ ID NO: 1736) |
| 55 ORF107_3_152324462_152326283_152344695_152347512_FR | OBD159_1469 | GTTCAACTTTTCCTGATTGTCACAGC (SEQ ID NO: 1738) |
| 56 ORF107_3_152324462_152326283_152344695_152347512_FR | OBD159_1469 | GTTCAACTTTTCCTGATTGTCACAGC (SEQ ID NO: 1738) |
| 57 ORF109_2_104433140_104437833_104474480_104478025_RF | OBD159_1473 | ATTTACATTCCTCCACTTCATTTA (SEQ ID NO: 1740) |
| 58 ORF109_2_104433140_104437833_104474480_104478025_RF | OBD159_1473 | ATTTACATTCCTCCACTTCATTTA (SEQ ID NO: 1740) |
| 59 ORF11_10_121564423_121570750_121595209_121596934_FF | OBD159_1477 | GGAGAAGGTTCCAGAAGCCGCCT (SEQ ID NO: 1742) |
| 60 ORF11_10_121564423_121570750_121595209_121596934_FF | OBD159_1477 | GGAGAAGGTTCCAGAAGCCGCCT (SEQ ID NO: 1742) |
| 61 ORF11_10_23011505_23013473_23072347_23075403_FF | OBD159_1481 | GGAATAGCCTTGCTTGTTTTGTGGCA (SEQ ID NO: 1744) |
| 62 ORF11_10_23011505_23013473_23072347_23075403_FF | OBD159_1481 | GGAATAGCCTTGCTTGTTTTGTGGCA (SEQ ID NO: 1744) |
| 63 ORF11_2_41846751_41848865_41954493_41957526_FF | OBD159_1485 | GGGCTTCCAGACATAAGACACAACTA (SEQ ID NO: 1746) |
| 64 ORF11_2_41846751_41848865_41954493_41957526_FF | OBD159_1485 | GGGCTTCCAGACATAAGACACAACTA (SEQ ID NO: 1746) |
| 65 ORF11_5_39079109_39081309_39147583_39150100_RF | OBD159_1489 | ATTCTCCTTTGCCCCTTCTCCTCCTC (SEQ ID NO: 1748) |
| 66 ORF11_5_39079109_39081309_39147583_39150100_RF | OBD159_1489 | ATTCTCCTTTGCCCCTTCTCCTCCTC (SEQ ID NO: 1748) |
| 67 ORF11_6_134192786_134196745_134322425_134324942_FR | OBD159_1493 | CTGAGAATGATTGTGGTTACCTGTTC (SEQ ID NO: 1750) |
| 68 ORF11_6_134192786_134196745_134322425_134324942_FR | OBD159_1493 | CTGAGAATGATTGTGGTTACCTGTTC (SEQ ID NO: 1750) |
| 69 ORF11_6_36576177_36578246_36622186_36625149_RF | OBD159_1497 | GGCAGTCTTCATTCTTGGCTCTA (SEQ ID NO: 1752) |
| 70 ORF11_6_36576177_36578246_36622186_36625149_RF | OBD159_1497 | GGCAGTCTTCATTCTTGGCTCTA (SEQ ID NO: 1752) |
| 71 ORF11_6_84775145_84786636_84804896_84812997_RR | OBD159_1501 | AGTCTATCTCGTGGAGGTTCGGC (SEQ ID NO: 1754) |
| 72 ORF11_6_84775145_84786636_84804896_84812997_RR | OBD159_1501 | AGTCTATCTCGTGGAGGTTCGGC (SEQ ID NO: 1754) |
| 73 ORF11_9_120675206_120677868_120725114_120727254_FR | OBD159_1505 | TTGTGCCACCACTTTTCCATTAGTAT (SEQ ID NO: 1756) |
| 74 ORF11_9_120675206_120677868_120725114_120727254_FR | OBD159_1505 | TTGTGCCACCACTTTTCCATTAGTAT (SEQ ID NO: 1756) |
| 75 ORF110_9_92403506_92407832_92438750_92441269_RF | OBD159_1509 | TCATACTTTTGGATGTTACTTACA (SEQ ID NO: 1758) |
| 76 ORF110_9_92403506_92407832_92438750_92441269_RF | OBD159_1509 | TCATACTTTTGGATGTTACTTACA (SEQ ID NO: 1758) |
| 77 ORF111_1_159074759_159077481_159117264_159124296_RR | OBD159_1513 | CCCTTTGAGATTTTGGATAGGAGTTT (SEQ ID NO: 1760) |

TABLE 3.a7-continued

| Probe | PCR-Primer1_ID | PCR_Primer1 |
|---|---|---|
| 78 ORF111_1_159074759_159077481_159117264_159124296_RR | OBD159_1513 | CCCTTTGAGATTTTGGATAGGAGTTT (SEQ ID NO: 1760) |
| 79 ORF112_10_112983990_112985695_112999906_113005525_RR | OBD159_1517 | GGGAAAGTCTATTGACCAACACTGCT (SEQ ID NO: 1762) |
| 80 ORF112_10_112983990_112985695_112999906_113005525_RR | OBD159_1517 | GGGAAAGTCTATTGACCAACACTGCT (SEQ ID NO: 1762) |
| 81 ORF112_2_104411249_104413918_104466236_104469082_FR | OBD159_1521 | CGGTAGACACCTCTTTTCCCTGC (SEQ ID NO: 1764) |
| 82 ORF112_2_104411249_104413918_104466236_104469082_FR | OBD159_1521 | CGGTAGACACCTCTTTTCCCTGC (SEQ ID NO: 1764) |
| 83 ORF112_22_26756491_26757562_26817002_26819259_FR | OBD159_1525 | GCAATCCCTCCAGCCCTTGTCAATCA (SEQ ID NO: 1766) |
| 84 ORF112_22_26756491_26757562_26817002_26819259_FR | OBD159_1525 | GCAATCCCTCCAGCCCTTGTCAATCA (SEQ ID NO: 1766) |
| 85 ORF_113_21_40396097_40402350_40423687_40428489_RR | OBD159_1529 | GGTGAGACATAGTAGCAAGGAAGAG G (SEQ ID NO: 1768) |
| 86 ORF113_21_40396097_40402350_40423687_40428489_RR | OBD159_1529 | GGTGAGACATAGTAGCAAGGAAGAG G (SEQ ID NO: 1768) |
| 87 ORF113_5_7540900_7542383_7606244_7610178_FR | OBD159_1533 | AATCTGAACTTAGACAGGCTGGCTGC (SEQ ID NO: 1770) |
| 88 ORF113_5_7540900_7542383_7606244_7610178_FR | OBD159_1533 | AATCTGAACTTAGACAGGCTGGCTGC (SEQ ID NO: 1770) |
| 89 ORF113_7_28717278_28719857_28769795_28772438_RR | OBD159_1537 | GCTAACCACCAGAGTCACACACATCA (SEQ ID NO: 1038) |
| 90 ORF113_7_28717278_28719857_28769795_28772438_RR | OBD159_1537 | GCTAACCACCAGAGTCACACACATCA (SEQ ID NO: 1038) |
| 91 ORF115_2_235136683_235138232_235199086_235201324_RF | OBD159_1541 | CACACCTACAAGTATTTTAGTTTA (SEQ ID NO: 1774) |
| 92 ORF115_2_235136683_235138232_235199086_235201324_RF | OBD159_1541 | CACACCTACAAGTATTTTAGTTTA (SEQ ID NO: 1774) |
| 93 ORF115_9_131590628_131592768_131654389_131655808_FR | OBD159_1545 | CTGTTCAAACCCGTCAGCAGGAT (SEQ ID NO: 972) |
| 94 ORF115_9_131590628_131592768_131654389_131655808_FR | OBD159_1545 | CTGTTCAAACCCGTCAGCAGGAT (SEQ ID NO: 972) |
| 95 ORF117_4_16871472_16876803_16929111_16933508_FF | OBD159_1549 | ATCCCTACCAACAGTAATCAGCAAAA (SEQ ID NO: 1778) |
| 96 ORF117_4_16871472_16876803_16929111_16933508_FF | OBD159_1549 | ATCCCTACCAACAGTAATCAGCAAAA (SEQ ID NO: 1778) |
| 97 ORF117_6_115981175_115984851_116027406_116036226_FR | OBD159_1553 | TGCCATTCACACAAAGTCTAAGGG (SEQ ID NO: 1780) |
| 98 ORF117_6_115981175_115984851_116027406_116036226_FR | OBD159_1553 | TGCCATTCACACAAAGTCTAAGGG (SEQ ID NO: 1780) |
| 99 ORF117_X_11308524_11309949_11364232_11365389_RR | OBD159_1557 | GGAGTGTCTCTTTGGGTCTCAATCAT (SEQ ID NO: 1782) |
| 100 ORF117_X_11308524_11309949_11364232_11365389_RR | OBD159_1557 | GGAGTGTCTCTTTGGGTCTCAATCAT (SEQ ID NO: 1782) |
| 101 ORF_118_3_58502739_58504383_58624445_58628835_FR | OBD159_1561 | ACGCACTTAGGAGGATTGTGTGTGTG (SEQ ID NO: 1784) |
| 102 ORF118_3_58502739_58504383_58624445_58628835_FR | OBD159_1561 | ACGCACTTAGGAGGATTGTGTGTGTG (SEQ ID NO: 1784) |
| 103 ORF118_4_84797792_84803613_84853916_84860994_FR | OBD159_1565 | CTTCCTCTTCAGTTACTTTCATCCAC (SEQ ID NO: 1786) |

TABLE 3.a7-continued

| Probe | PCR-Primer1_ID | PCR_Primer1 |
|---|---|---|
| 104ORF118_4_84797792_84803613_84853916_84860994_FR | OBD159_1565 | CTTCCTCTTCAGTTACTTTCATCCAC (SEQ ID NO: 1786) |
| 105ORF119_6_73688989_73690148_73720087_73722647_FR | OBD159_1569 | TCAGTGTTTGCTTTTCCCTTGAAT (SEQ ID NO: 718) |
| 106ORF119_6_73688989_73690148_73720087_73722647_FR | OBD159_1569 | TCAGTGTTTGCTTTTCCCTTGAAT (SEQ ID NO: 718) |
| 107ORF12_10_14331424_14334008_14346291_14350333_RR | OBD159_1573 | GATGAAGTCTTGCTATGTTGCCTA (SEQ ID NO: 1790) |
| 108ORF12_10_14331424_14334008_14346291_14350333_RR | OBD159_1573 | GATGAAGTCTTGCTATGTTGCCTA (SEQ ID NO: 1790) |
| 109ORF12_11_87926403_87934326_87969207_88006264_FR | OBD159_1577 | CCAATAACCTTCCAGCATCTCCCTGA (SEQ ID NO: 1792) |
| 110ORF12_11_87926403_87934326_87969207_88006264_FR | OBD159_1577 | CCAATAACCTTCCAGCATCTCCCTGA (SEQ ID NO: 1792) |

TABLE 3.a8

| | PCR-Primer2_ID | PCR_Primer2 | Marker | GLMNET |
|---|---|---|---|---|
| 1 | OBD159_1363 | GCACCATCAGGCTTCTGGGAATG (SEQ ID NO: 1794) | OBD159_1361_1363 | 0.000483127 |
| 2 | OBD159_1363 | GCACCATCAGGCTTCTGGGAATG (SEQ ID NO: 1794) | OBD159_1361_1363 | 0.000483127 |
| 3 | OBD159_1367 | CCCACAGGGTTGGCAGTGAGATG (SEQ ID NO: 1796) | OBD159_1365_1367 | 0.001975911 |
| 4 | OBD159_1367 | CCCACAGGGTTGGCAGTGAGATG (SEQ ID NO: 1796) | OBD159_1365_1367 | 0.001975911 |
| 5 | OBD159_1371 | TTCTCTATTCTTCCCTTCCCTTTT (SEQ ID NO: 1798) | OBD159_1369_1371 | 0.000206239 |
| 6 | OBD159_1371 | TTCTCTATTCTTCCCTTCCCTTTT (SEQ ID NO: 1798) | OBD159_1369_1371 | 0.000206239 |
| 7 | OBD159_1375 | GGCACCCAGAGGCTCCTTTGGAA (SEQ ID NO: 1800) | OBD159_1373_1375 | 0.000139185 |
| 8 | OBD159_1375 | GGCACCCAGAGGCTCCTTTGGAA (SEQ ID NO: 1800) | OBD159_1373_1375 | 0.000139185 |
| 9 | OBD159_1379 | GCTGTGGACTGGGTAAATAAAGTGTG (SEQ ID NO: 1802) | OBD159_1377_1379 | 0.000611043 |
| 10 | OBD159_1379 | GCTGTGGACTGGGTAAATAAAGTGTG (SEQ ID NO: 1802) | OBD159_1377_1379 | 0.000611043 |
| 11 | OBD159_1383 | GCAGGGATGAGGATAGTAAACCAAT (SEQ ID NO: 1804) | OBD159_1381_1383 | 0.001134506 |
| 12 | OBD159_1383 | GCAGGGATGAGGATAGTAAACCAAT (SEQ ID NO: 1804) | OBD159_1381_1383 | 0.001134506 |
| 13 | OBD159_1387 | TTCATCACTCCTTTCATCTCACCAGC (SEQ ID NO: 1806) | OBD159_1385_1387 | 0.001275093 |
| 14 | OBD159_1387 | TTCATCACTCCTTTCATCTCACCAGC (SEQ ID NO: 1806) | OBD159_1385_1387 | 0.001275093 |
| 15 | OBD159_1391 | CTTAGGCAACAATGTGTGGGCTCCTG (SEQ ID NO: 1808) | OBD159_1389_1391 | 0.000870192 |
| 16 | OBD159_1391 | CTTAGGCAACAATGTGTGGGCTCCTG (SEQ ID NO: 1808) | OBD159_1389_1391 | 0.000870192 |

TABLE 3.a8-continued

| | PCR-Primer2_ID | PCR_Primer2 | Marker | GLMNET |
|---|---|---|---|---|
| 17 | OBD159_1395 | GAGATGAAGTCTTGCTATGTTGCCTA (SEQ ID NO: 1810) | OBD159_1393_1395 | 0.000683889 |
| 18 | OBD159_1395 | GAGATGAAGTCTTGCTATGTTGCCTA (SEQ ID NO: 1810) | OBD159_1393_1395 | 0.000683889 |
| 19 | OBD159_1399 | GCTGACAGGCAAGGTGAAAATCAACA (SEQ ID NO: 1812) | OBD159_1397_1399 | 0.000831118 |
| 20 | OBD159_1399 | GCTGACAGGCAAGGTGAAAATCAACA (SEQ ID NO: 1812) | OBD159_1397_1399 | 0.000831118 |
| 21 | OBD159_1403 | CCATAGAGGGTAGGTAGGACTTCAAT (SEQ ID NO: 1814) | OBD159_1401_1403 | 0.002341565 |
| 22 | OBD159_1403 | CCATAGAGGGTAGGTAGGACTTCAAT (SEQ ID NO: 1814) | OBD159_1401_1403 | 0.002341565 |
| 23 | OBD159_1407 | CCTGGCTGAAGACCTGGCTACTC (SEQ ID NO: 1816) | OBD159_1405_1407 | 0.001148769 |
| 24 | OBD159_1407 | CCTGGCTGAAGACCTGGCTACTC (SEQ ID NO: 1816) | OBD159_1405_1407 | 0.001148769 |
| 25 | OBD159_1411 | GGTTGCCTGTGTGGTGATAGGTGACA (SEQ ID NO: 1818) | OBD159_1409_1411 | 0.001747902 |
| 26 | OBD159_1411 | GGTTGCCTGTGTGGTGATAGGTGACA (SEQ ID NO: 1818) | OBD159_1409_1411 | 0.001747902 |
| 27 | OBD159_1415 | AAATCATCCCCAATCCAGAACTGA (SEQ ID NO: 1820) | OBD159_1413_1415 | 0.000852496 |
| 28 | OBD159_1415 | AAATCATCCCCAATCCAGAACTGA (SEQ ID NO: 1820) | OBD159_1413_1415 | 0.000852496 |
| 29 | OBD159_1419 | GGAATGAAACAGGGCACAGAATAAGG (SEQ ID NO: 1822) | OBD159_1417_1419 | 0.00135607 |
| 30 | OBD159_1419 | GGAATGAAACAGGGCACAGAATAAGG (SEQ ID NO: 1822) | OBD159_1417_1419 | 0.00135607 |
| 31 | OBD159_1423 | AACAGAGAGGCTGAGGTGCCCACATT (SEQ ID NO: 1824) | OBD159_1421_1423 | 4.20E-05 |
| 32 | OBD159_1423 | AACAGAGAGGCTGAGGTGCCCACATT (SEQ ID NO: 1824) | OBD159_1421_1423 | 4.20E-05 |
| 33 | OBD159_1427 | GGAGCAGAGACTTGAATACAATGAGG (SEQ ID NO: 1826) | OBD159_1425_1427 | 0.001395875 |
| 34 | OBD159_1427 | GGAGCAGAGACTTGAATACAATGAGG (SEQ ID NO: 1826) | OBD159_1425_1427 | 0.001395875 |
| 35 | OBD159_1431 | CTTATCAACAGGCTTACTCTCACCTC (SEQ ID NO: 1828) | OBD159_1429_1431 | -0.000169106 |
| 36 | OBD159_1431 | CTTATCAACAGGCTTACTCTCACCTC (SEQ ID NO: 1828) | OBD159_1429_1431 | -0.000169106 |
| 37 | OBD159_1435 | CCACCTTTCTCCTGAAGCCAGCC (SEQ ID NO: 1830) | OBD159_1433_1435 | 0.001463436 |
| 38 | OBD159_1435 | CCACCTTTCTCCTGAAGCCAGCC (SEQ ID NO: 1830) | OBD159_1433_1435 | 0.001463436 |
| 39 | OBD159_1439 | AGGAACCAGGCACCCATTCAGGG (SEQ ID NO: 1832) | OBD159_1437_1439 | 0.000491367 |
| 40 | OBD159_1439 | AGGAACCAGGCACCCATTCAGGG (SEQ ID NO: 1832) | OBD159_1437_1439 | 0.000491367 |
| 41 | OBD159_1443 | TCTAAACCCCACTGGTCATCTCAG (SEQ ID NO: 1834) | OBD159_1441_1443 | 0.00197459 |
| 42 | OBD159_1443 | TCTAAACCCCACTGGTCATCTCAG (SEQ ID NO: 1834) | OBD159_1441_1443 | 0.00197459 |

TABLE 3.a8-continued

| | PCR-Primer2_ID | PCR_Primer2 | Marker | GLMNET |
|---|---|---|---|---|
| 43 | OBD159_1447 | GTAGAATGGGTTGACCTGATAAGC (SEQ ID NO: 1836) | OBD159_1445_1447 | 0.000659523 |
| 44 | OBD159_1447 | GTAGAATGGGTTGACCTGATAAGC (SEQ ID NO: 1836) | OBD159_1445_1447 | 0.000659523 |
| 45 | OBD159_1451 | CTCTAAGTCCCTGAACACAGTAAGAA (SEQ ID NO: 1838) | OBD159_1449_1451 | 0.000290692 |
| 46 | OBD159_1451 | CTCTAAGTCCCTGAACACAGTAAGAA (SEQ ID NO: 1838) | OBD159_1449_1451 | 0.000290692 |
| 47 | OBD159_1455 | GGCATCACAGTGGACTCCCTCAAACA (SEQ ID NO: 1840) | OBD159_1453_1455 | 0.000175588 |
| 48 | OBD159_1455 | GGCATCACAGTGGACTCCCTCAAACA (SEQ ID NO: 1840) | OBD159_1453_1455 | 0.000175588 |
| 49 | OBD159_1459 | CCACCTTCGCCTCCTGTGTTGTTATG (SEQ ID NO: 1842) | OBD159_1457_1459 | 0.002356539 |
| 50 | OBD159_1459 | CCACCTTCGCCTCCTGTGTTGTTATG (SEQ ID NO: 1842) | OBD159_1457_1459 | 0.002356539 |
| 51 | OBD159_1463 | CACCCCACACTGTCACTCTTTGCTCT (SEQ ID NO: 1844) | OBD159_1461_1463 | 0.002388817 |
| 52 | OBD159_1463 | CACCCCACACTGTCACTCTTTGCTCT (SEQ ID NO: 1844) | OBD159_1461_1463 | 0.002388817 |
| 53 | OBD159_1467 | GGAAATGCTCCGCCGAATACAATGAC (SEQ ID NO: 1846) | OBD159_1465_1467 | 0.00088211 |
| 54 | OBD159_1467 | GGAAATGCTCCGCCGAATACAATGAC (SEQ ID NO: 1846) | OBD159_1465_1467 | 0.00088211 |
| 55 | OBD159_1471 | GTCTGTGTGTCTTTGTGTGCCTTTCC (SEQ ID NO: 1848) | OBD159_1469_1471 | 0.000579193 |
| 56 | OBD159_1471 | GTCTGTGTGTCTTTGTGTGCCTTTCC (SEQ ID NO: 1848) | OBD159_1469_1471 | 0.000579193 |
| 57 | OBD159_1475 | AGAAATCACCAACAGCAGAACCAT (SEQ ID NO: 1850) | OBD159_1473_1475 | 0.001511766 |
| 58 | OBD159_1475 | AGAAATCACCAACAGCAGAACCAT (SEQ ID NO: 1850) | OBD159_1473_1475 | 0.001511766 |
| 59 | OBD159_1479 | GCGTCCAATCAGAACTTGCGAGC (SEQ ID NO: 1852) | OBD159_1477_1479 | 0.000720571 |
| 60 | OBD159_1479 | GCGTCCAATCAGAACTTGCGAGC (SEQ ID NO: 1852) | OBD159_1477_1479 | 0.000720571 |
| 61 | OBD159_1483 | GAGAAGGGAGGTAAAATGTAATCAAC (SEQ ID NO: 1854) | OBD159_1481_1483 | 0.000499411 |
| 62 | OBD159_1483 | GAGAAGGGAGGTAAAATGTAATCAAC (SEQ ID NO: 1854) | OBD159_1481_1483 | 0.000499411 |
| 63 | OBD159_1487 | GTGGCTACACCCGAGAGGGAAACTAA (SEQ ID NO: 1856) | OBD159_1485_1487 | 0.00241081 |
| 64 | OBD159_1487 | GTGGCTACACCCGAGAGGGAAACTAA (SEQ ID NO: 1856) | OBD159_1485_1487 | 0.00241081 |
| 65 | OBD159_1491 | GGTGTCCTTATCAGTAAACAACTTCC (SEQ ID NO: 1858) | OBD159_1489_1491 | 0.001400012 |
| 66 | OBD159_1491 | GGTGTCCTTATCAGTAAACAACTTCC (SEQ ID NO: 1858) | OBD159_1489_1491 | 0.001400012 |
| 67 | OBD159_1495 | AATCCCCAGCAGGGTTTCCTAAT (SEQ ID NO: 1860) | OBD159_1493_1495 | 0.001528487 |
| 68 | OBD159_1495 | AATCCCCAGCAGGGTTTCCTAAT (SEQ ID NO: 1860) | OBD159_1493_1495 | 0.001528487 |

TABLE 3.a8-continued

| | PCR-Primer2_ID | PCR_Primer2 | Marker | GLMNET |
|---|---|---|---|---|
| 69 | OBD159_1499 | GATTCTTGGTTGTTGGCTGGGATTA (SEQ ID NO: 1862) | OBD159_1497_1499 | 4.59E-05 |
| 70 | OBD159_1499 | GATTCTTGGTTGTTGGCTGGGATTA (SEQ ID NO: 1862) | OBD159_1497_1499 | 4.59E-05 |
| 71 | OBD159_1503 | GGAGCAGGTGGACCATCTGTTCC (SEQ ID NO: 1864) | OBD159_1501_1503 | 0.000940181 |
| 72 | OBD159_1503 | GGAGCAGGTGGACCATCTGTTCC (SEQ ID NO: 1864) | OBD159_1501_1503 | 0.000940181 |
| 73 | OBD159_1507 | ACTGACTGATTTGGGTCTGATGGTGG (SEQ ID NO: 1866) | OBD159_1505_1507 | 0.000811594 |
| 74 | OBD159_1507 | ACTGACTGATTTGGGTCTGATGGTGG (SEQ ID NO: 1866) | OBD159_1505_1507 | 0.000811594 |
| 75 | OBD159_1511 | TAGTATGTCTGCTGAAGGCACTTA (SEQ ID NO: 1868) | OBD159_1509_1511 | 0.001026187 |
| 76 | OBD159_1511 | TAGTATGTCTGCTGAAGGCACTTA (SEQ ID NO: 1868) | OBD159_1509_1511 | 0.001026187 |
| 77 | OBD159_1515 | TTTCCTATCTTCCCACCTCTTCTGCC (SEQ ID NO: 1870) | OBD159_1513_1515 | 0.001007363 |
| 78 | OBD159_1515 | TTTCCTATCTTCCCACCTCTTCTGCC (SEQ ID NO: 1870) | OBD159_1513_1515 | 0.001007363 |
| 79 | OBD159_1519 | TCTCCAAGAGGCAACTGCTTAGACAG (SEQ ID NO: 1872) | OBD159_1517_1519 | 0.00022376 |
| 80 | OBD159_1519 | TCTCCAAGAGGCAACTGCTTAGACAG (SEQ ID NO: 1872) | OBD159_1517_1519 | 0.00022376 |
| 81 | OBD159_1523 | GTGCCTTCCACCAGAGTCCACATC (SEQ ID NO: 1874) | OBD159_1521_1523 | 0.00106458 |
| 82 | OBD159_1523 | GTGCCTTCCACCAGAGTCCACATC (SEQ ID NO: 1874) | OBD159_1521_1523 | 0.00106458 |
| 83 | OBD159_1527 | GCCAAGCAGGTTTTGATAATCCAAGG (SEQ ID NO: 1876) | OBD159_1525_1527 | 0.000806912 |
| 84 | OBD159_1527 | GCCAAGCAGGTTTTGATAATCCAAGG (SEQ ID NO: 1876) | OBD159_1525_1527 | 0.000806912 |
| 85 | OBD159_1531 | CTCCGCTCTTGGATTTCTGCCCATTA (SEQ ID NO: 1878) | OBD159_1529_1531 | 0.000966015 |
| 86 | OBD159_1531 | CTCCGCTCTTGGATTTCTGCCCATTA (SEQ ID NO: 1878) | OBD159_1529_1531 | 0.000966015 |
| 87 | OBD159_1535 | GGACATAAGCCCAAACAGGAACACTG (SEQ ID NO: 1880) | OBD159_1533_1535 | 0.001252937 |
| 88 | OBD159_1535 | GGACATAAGCCCAAACAGGAACACTG (SEQ ID NO: 1880) | OBD159_1533_1535 | 0.001252937 |
| 89 | OBD159_1539 | CCATCCCAGTTTCACCATTGGCAAGA (SEQ ID NO: 1882) | OBD159_1537_1539 | 0.000426768 |
| 90 | OBD159_1539 | CCATCCCAGTTTCACCATTGGCAAGA (SEQ ID NO: 1882) | OBD159_1537_1539 | 0.000426768 |
| 91 | OBD159_1543 | TTTAGAGCGGTGAGACAGTGACAC (SEQ ID NO: 1884) | OBD159_1541_1543 | 0.00080326 |
| 92 | OBD159_1543 | TTTAGAGCGGTGAGACAGTGACAC (SEQ ID NO: 1884) | OBD159_1541_1543 | 0.00080326 |
| 93 | OBD159_1547 | CCGCCCCAGCCTCCCAAAGTGCT (SEQ ID NO: 1886) | OBD159_1545_1547 | 0.000288908 |
| 94 | OBD159_1547 | CCGCCCCAGCCTCCCAAAGTGCT (SEQ ID NO: 1886) | OBD159_1545_1547 | 0.000288908 |

TABLE 3.a8-continued

| | PCR-Primer2_ID | PCR_Primer2 | Marker | GLMNET |
|---|---|---|---|---|
| 95 | OBD159_1551 | GGGATAGTTAGAAAGAGAAGATGAGA (SEQ ID NO: 1888) | OBD159_1549_1551 | 0.001395559 |
| 96 | OBD159_1551 | GGGATAGTTAGAAAGAGAAGATGAGA (SEQ ID NO: 1888) | OBD159_1549_1551 | 0.001395559 |
| 97 | OBD159_1555 | CTTTTGAATAGTTCTTACTTTATGC (SEQ ID NO: 1890) | OBD159_1553_1555 | 0.001054768 |
| 98 | OBD159_1555 | CTTTTGAATAGTTCTTACTTTATGC (SEQ ID NO: 1890) | OBD159_1553_1555 | 0.001054768 |
| 99 | OBD159_1559 | GGGTAGGCAACTAACTGAGGCTGCTA (SEQ ID NO: 1892) | OBD159_1557_1559 | 0.000454783 |
| 100 | OBD159_1559 | GGGTAGGCAACTAACTGAGGCTGCTA (SEQ ID NO: 1892) | OBD159_1557_1559 | 0.000454783 |
| 101 | OBD159_1563 | GGAAGGGAGAGTGCTGGACATTTCAT (SEQ ID NO: 1894) | OBD159_1561_1563 | 0.00210011 |
| 102 | OBD159_1563 | GGAAGGGAGAGTGCTGGACATTTCAT (SEQ ID NO: 1894) | OBD159_1561_1563 | 0.00210011 |
| 103 | OBD159_1567 | TTCCCACCCCAGGCATTCTCTTTCAG (SEQ ID NO: 1896) | OBD159_1565_1567 | 0.000488724 |
| 104 | OBD159_1567 | TTCCCACCCCAGGCATTCTCTTTCAG (SEQ ID NO: 1896) | OBD159_1565_1567 | 0.000488724 |
| 105 | OBD159_1571 | CTGAAAATGACAAGACCTCCTTCT (SEQ ID NO: 1898) | OBD159_1569_1571 | -1.93E-05 |
| 106 | OBD159_1571 | CTGAAAATGACAAGACCTCCTTCT (SEQ ID NO: 1898) | OBD159_1569_1571 | -1.93E-05 |
| 107 | OBD159_1575 | TTGCCATCTCTTTGTTCAAGTTTT (SEQ ID NO: 1900) | OBD159_1573_1575 | 0.003218258 |
| 108 | OBD159_1575 | TTGCCATCTCTTTGTTCAAGTTTT (SEQ ID NO: 1900) | OBD159_1573_1575 | 0.003218258 |
| 109 | OBD159_1579 | CCAACTGTGCCAAAGGATGATGATGG (SEQ ID NO: 1902) | OBD159_1577_1579 | 0.00255055 |
| 110 | OBD159_1579 | CCAACTGTGCCAAAGGATGATGATGG (SEQ ID NO: 1902) | OBD159_1577_1579 | 0.00255055 |

TABLE 3.a9

| | Gene |
|---|---|
| 1 | GABARAPL1; KLRD1; TMEM52B |
| 2 | GABARAPL1; KLRD1; TMEM52B |
| 3 | HSPH1; TEX26 |
| 4 | HSPH1; TEX26 |
| 5 | AKAP5; MTHFD1; ZBTB25; rs34181110; rs2236225; rs2281603; rs17824591 |
| 6 | AKAP5; MTHFD1; ZBTB25; rs34181110; rs2236225; rs2281603; rs17824591 |
| 7 | rs7556897; rs4973341; rs1811711 |
| 8 | rs7556897; rs4973341; rs1811711 |
| 9 | RIN2; rs181853315 |
| 10 | RIN2; rs181853315 |
| 11 | INHBA; rs6976118 |
| 12 | INHBA; rs6976118 |
| 13 | INHBA; rs6976118 |
| 14 | INHBA; rs6976118 |
| 15 | FBXO16; FZD3 |
| 16 | FBXO16; FZD3 |
| 17 | FRMD4A; rs1218412; rs12220909 |
| 18 | FRMD4A; rs1218412; rs12220909 |
| 19 | DDX10; rs10890917 |
| 20 | DDX10; rs10890917 |
| 21 | FAM124A; INTS6; SERPINE3 |
| 22 | FAM124A; INTS6; SERPINE3 |
| 23 | MAP4K3; TMEM178A |

TABLE 3.a9-continued

| | Gene |
|---|---|
| 24 | MAP4K3; TMEM178A |
| 25 | LDB2; rs10939673 |
| 26 | LDB2; rs10939673 |
| 27 | SUMO4; TAB2; rs267607101; rs267607100; rs1057518422; rs237025; rs2153219 |
| 28 | SUMO4; TAB2; rs267607101; rs267607100; rs1057518422; rs237025; rs2153219 |
| 29 | MSRA; rs10107815; rs73191547; rs17749155; rs2975735; rs7001567 |
| 30 | MSRA; rs10107815; rs73191547; rs17749155; rs2975735; rs7001567 |
| 31 | PDP1; rs7006531 |
| 32 | PDP1; rs7006531 |
| 33 | SIAH3; ZC3H13 |
| 34 | SIAH3; ZC3H13 |
| 35 | LINGO2; rs7851437 |
| 36 | LINGO2; rs7851437 |
| 37 | FOXD4L3; PGM5 |
| 38 | FOXD4L3; PGM5 |
| 39 | LUZP4; PLS3 |
| 40 | LUZP4; PLS3 |
| 41 | TXNDC2; VAPA; rs29067; rs29066 |
| 42 | TXNDC2; VAPA; rs29067; rs29066 |
| 43 | PROX1; rs7529073; rs79687284; rs2075423; rs340874; rs340839; rs7541039; rs6665764; rs3767844 |
| 44 | PROX1; rs7529073; rs79687284; rs2075423; rs340874; rs340839; rs7541039; rs6665764; rs3767844 |
| 45 | rs10752212; rs62209 |
| 46 | rs10752212; rs62209 |
| 47 | GNG2; rs8015138 |
| 48 | GNG2; rs8015138 |
| 49 | NEDD4L; rs17064520; rs2288774 |
| 50 | NEDD4L; rs17064520; rs2288774 |
| 51 | CDH26; FAM217B; PPP1R3D; SYCP2 |
| 52 | CDH26; FAM217B; PPP1R3D; SYCP2 |
| 53 | CDS1; WDFY3 |
| 54 | CDS1; WDFY3 |
| 55 | MBNL1; TMEM14E; rs185894411 |
| 56 | MBNL1; TMEM14E; rs185894411 |
| 57 | rs62152284; rs12615966 |
| 58 | rs62152284; rs12615966 |
| 59 | FGFR2; rs148514974; rs10510097; rs4752569; rs3750817; rs7895676; rs10736303; rs11200014; rs2981579; rs1078806; rs2981578; rs35054928; rs2981575; rs1219648; rs1219642; rs2912774; rs2936870; rs45631563; rs2420946; rs3135724; rs2981582; rs3135718; rs755001161 |
| 60 | FGFR2; rs148514974; rs10510097; rs4752569; rs3750817; rs7895676; rs10736303; rs11200014; rs2981579; rs1078806; rs2981578; rs35054928; rs2981575; rs1219648; rs1219642; rs2912774; rs2936870; rs45631563; rs2420946; rs3135724; rs2981582; rs3135718; rs755001161 |
| 61 | ARMC3; MSRB2 |
| 62 | ARMC3; MSRB2 |
| 63 | C2orf91; rs4305317; rs6740960; rs10211025 |
| 64 | C2orf91; rs4305317; rs6740960; rs10211025 |
| 65 | FYB; RICTOR; rs1060505056 |
| 66 | FYB; RICTOR; rs1060505056 |
| 67 | SGK1; rs1009840; rs4896030; rs9493873; rs1743966 |
| 68 | SGK1; rs1009840; rs4896030; rs9493873; rs1743966 |
| 69 | SRSF3; rs7771547 |
| 70 | SRSF3; rs7771547 |
| 71 | rs77693245; rs72912698 |
| 72 | rs77693245; rs72912698 |
| 73 | MEGF9; rs7044106 |
| 74 | MEGF9; rs7044106 |
| 75 | ASPN; CENPP; OGN; OMD |
| 76 | ASPN; CENPP; OGN; OMD |
| 77 | AIM2; rs855871; rs855873; rs855866; rs855867; rs2852720; rs2518564; rs2814764; rs1894043; rs2852727; rs1894044; rs2518569 |
| 78 | AIM2; rs855871; rs855873; rs855866; rs855867; rs2852720; rs2518564; rs2814764; rs1894043; rs2852727; rs1894044; rs2518569 |
| 79 | TCF7L2; rs17747324; rs34872471; rs7901695; rs4506565; rs7903146; rs4132670 |
| 80 | TCF7L2; rs17747324; rs34872471; rs7901695; rs4506565; rs7903146; rs4132670 |
| 81 | rs62152284; rs12615966 |
| 82 | rs62152284; rs12615966 |
| 83 | rs9608521; rs1894720 |
| 84 | rs9608521; rs1894720 |
| 85 | DSCAM; rs9980603 |
| 86 | DSCAM; rs9980603 |
| 87 | ADCY2; rs17231202; rs10512928; rs884964; rs12522444; rs11134242; rs4530734; rs12519539; rs34043481 |
| 88 | ADCY2; rs17231202; rs10512928; rs884964; rs12522444; rs11134242; rs4530734; rs12519539; rs34043481 |
| 89 | CREB5; rs56388170 |
| 90 | CREB5; rs56388170 |
| 91 | SH3BP4; rs6431360 |
| 92 | SH3BP4; rs6431360 |
| 93 | RAPGEF1; rs11243444; rs4740283 |

TABLE 3.a9-continued

| | Gene |
|---|---|
| 94 | RAPGEF1; rs11243444; rs4740283 |
| 95 | LDB2; rs12503223 |
| 96 | LDB2; rs12503223 |
| 97 | FRK; rs1933737; rs9488822; rs3822857; rs868943; rs6909746; rs1999930 |
| 98 | FRK; rs1933737; rs9488822; rs3822857; rs868943; rs6909746; rs1999930 |
| 99 | AMELX; ARHGAP6 |
| 100 | AMELX; ARHGAP6 |
| 101 | ACOX2; FAM107A; KCTD6; rs150832314; rs1057519329; rs11539086; rs13315591 |
| 102 | ACOX2; FAM107A; KCTD6; rs150832314; rs1057519329; rs11539086; rs13315591 |
| 103 | CDS1; WDFY3 |
| 104 | CDS1; WDFY3 |
| 105 | CD109; SLC17A5 |
| 106 | CD109; SLC17A5 |
| 107 | FRMD4A; rs1218412 |
| 108 | FRMD4A; rs1218412 |
| 109 | rs16914161 |
| 110 | rs16914161 |

TABLE 3.b1

| | Probe | GeneLocus |
|---|---|---|
| 111 | ORF12_12_99003375_99005607_99054128_99056579_FR | ANKS1B; rs7960581 |
| 112 | ORF12_12_99003375_99005607_99054128_99056579_FR | ANKS1B; rs7960581 |
| 113 | ORF12_6_157429181_157433330_157512149_157514915_FF | TMEM242; ZDHHC14; rs181143083 |
| 114 | ORF12_6_157429181_157433330_157512149_157514915_FF | TMEM242; ZDHHC14; rs181143083 |
| 115 | ORF12_7_147567494_147568852_147649122_147653562_FR | CNTNAP2; rs201076428; rs6944808 |
| 116 | ORF12_7_147567494_147568852_147649122_147653562_FR | CNTNAP2; rs201076428; rs6944808 |
| 117 | ORF120_21_34062321_34063413_34127427_34131035_RF | MRPS6; SLC5A3; rs2834319 |
| 118 | ORF120_21_34062321_34063413_34127427_34131035_RF | MRPS6; SLC5A3; rs2834319 |
| 119 | ORF121_10_121118423_121121606_121215466_121226127_RF | rs1907240; rs2257129; rs3943077; rs35668226 |
| 120 | ORF121_10_121118423_121121606_121215466_121226127_RF | rs1907240; rs2257129; rs3943077; rs35668226 |
| 121 | ORF122_5_42377041_42385919_42468953_42471569_FF | GHR; rs6898743 |
| 122 | ORF122_5_42377041_42385919_42468953_42471569_FF | GHR; rs6898743 |
| 123 | ORF123_5_159206195_159208288_159235024_159243123_RF | RNF145; rs2901184; rs10515778; rs55801554 |
| 124 | ORF123_5_159206195_159208288_159235024_159243123_RF | RNF145; rs2901184; rs10515778; rs55801554 |
| 125 | ORF125_15_96265261_96271086_96328347_96331473_RR | NR2F2; rs2398180; rs587777373 |
| 126 | ORF125_15_96265261_96271086_96328347_96331473_RR | NR2F2; rs2398180; rs587777373 |
| 127 | ORF125_6_158443203_158448925_158476552_158477736_FF | TULP4; rs9456307 |
| 128 | ORF125_6_158443203_158448925_158476552_158477736_FF | TULP4; rs9456307 |
| 129 | ORF126_13_99298431_99304510_99373432_99375888_RR | GPR183; UBAC2; rs9557195; rs9513593 |
| 130 | ORF126_13_99298431_99304510_99373432_99375888_RR | GPR183; UBAC2; rs9557195; rs9513593 |
| 131 | ORF127_11_120012095_120020785_120066945_120072959_FR | PVRL1; TRIM29 |
| 132 | ORF127_11_120012095_120020785_120066945_120072959_FR | PVRL1; TRIM29 |
| 133 | ORF128_14_74830356_74835394_74873740_74878249_RR | DLST; PROX2; YLPM1 |
| 134 | ORF128_14_74830356_74835394_74873740_74878249_RR | DLST; PROX2; YLPM1 |
| 135 | ORF13_10_121477867_121479994_121564423_121570750_RF | FGFR2; rs749474548; rs1057519795; rs1057520029; rs1057520027; rs879253720; rs121918508; rs1057519047; rs1057519854; rs777169135; rs121918509; rs1057519796; rs751047267; rs121918506; rs1057519797; rs121913476; rs1057519045; rs1057519901; rs1057519798; rs1057519799; rs1057519800; rs121918507; rs1057520044; rs751731391; rs387906677; rs1057519900; rs387906678; rs121913478; rs1057520028; rs121913477; rs879253721; rs121918490; rs121918502; rs121918494; rs121918491; rs121918492; rs121918496; rs121918487; rs121918488; rs121918495; rs121918489; rs1057519044; rs1057519043; rs387906676; rs1057519042; rs121918493; rs121918510; rs121918504; rs1057519791; rs121913475; rs1057519040; rs374608214; rs121918500; rs121918499; rs1057519039; rs121918501; rs121918497; rs1057519038; rs776587763; rs1057519036; rs879253718; rs121918505; rs779326224; rs387907372; rs77543610; rs121918498; rs79184941; rs3135753; rs11199993; rs755001161; rs148514974; rs10510097; rs4752569 |
| 136 | ORF13_10_121477867_121479994_121564423_121570750_RF | FGFR2; rs749474548; rs1057519795; rs1057520029; rs1057520027; rs879253720; rs121918508; rs1057519047; rs1057519854; rs777169135; rs121918509; rs1057519796; |

TABLE 3.b1-continued

| | Probe | GeneLocus |
|---|---|---|
| | | rs751047267; rs121918506; rs1057519797; rs121913476; rs1057519045; rs1057519901; rs1057519798; rs1057519799; rs1057519800; rs121918507; rs1057520044; rs751731391; rs387906677; rs1057519900; rs387906678; rs121913478; rs1057520028; rs121913477; rs879253721; rs121918490; rs121918502; rs121918494; rs121918491; rs121918492; rs121918496; rs121918487; rs121918488; rs121918495; rs121918489; rs1057519044; rs1057519043; rs387906676; rs1057519042; rs121918493; rs121918510; rs121918504; rs1057519791; rs121913475; rs1057519040; rs374608214; rs121918500; rs121918499; rs1057519039; rs121918501; rs121918497; rs1057519038; rs776587763; rs1057519036; rs879253718; rs121918505; rs779326224; rs387907372; rs77543610; rs121918498; rs79184941; rs3135753; rs11199993; rs755001161; rs148514974; rs10510097; rs4752569 |
| 137 | ORF13_13_23148292_23151659_23204130_23213800_RR | SGCG; rs76916029; rs764468720; rs138880406; rs781760379; rs200502077; rs797045106; rs570169794 |
| 138 | ORF13_13_23148292_23151659_23204130_23213800_RR | SGCG; rs76916029; rs764468720; rs138880406; rs781760379; rs200502077; rs797045106; rs570169794 |
| 139 | ORF13_13_45996676_46000524_46057524_46060260_RR | CPB2; ZC3H13; rs1926447; rs779491029; rs3742264 |
| 140 | ORF13_13_45996676_46000524_46057524_46060260_RR | CPB2; ZC3H13; rs1926447; rs779491029; rs3742264 |
| 141 | ORF13_15_96275929_96277834_96328347_96331473_RR | NR2F2; rs2398180; rs587777373 |
| 142 | ORF13_15_96275929_96277834_96328347_96331473_RR | NR2F2; rs2398180; rs587777373 |
| 143 | ORF13_2_65241569_65243972_65289753_65296291_FR | ACTR2; SPRED2; rs62139085 |
| 144 | ORF13_2_65241569_65243972_65289753_65296291_FR | ACTR2; SPRED2; rs62139085 |
| 145 | ORF13_2_79971437_79976448_80050108_80055044_RF | CTNNA2; rs6738962; rs13427272 |
| 146 | ORF13_2_79971437_79976448_80050108_80055044_RF | CTNNA2; rs6738962; rs13427272 |
| 147 | ORF13_6_23219349_23223439_23271280_23277154_RF | rs7771911 |
| 148 | ORF13_6_23219349_23223439_23271280_23277154_RF | rs7771911 |
| 149 | ORF13_7_155741321_155744332_155779388_155780808_FR | RBM33; SHH |
| 150 | ORF13_7_155741321_155744332_155779388_155780808_FR | RBM33; SHH |
| 151 | ORF131_20_8536736_8541378_8590421_8594259_FR | PLCB1; rs4432538 |
| 152 | ORF131_20_8536736_8541378_8590421_8594259_FR | PLCB1; rs4432538 |
| 153 | ORF132_5_173916958_173918697_173969421_173970862_RR | C5orf47; CPEB4; rs10516107; rs6861681; rs17076724; rs17076726; rs56163845; rs72812846; rs72812861 |
| 154 | ORF132_5_173916958_173918697_173969421_173970862_RR | C5orf47; CPEB4; rs10516107; rs6861681; rs17076724; rs17076726; rs56163845; rs72812846; rs72812861 |
| 155 | ORF132_7_117292584_117297912_117353457_117366529_RF | ASZ1; WNT2; rs114167782; rs749398878; rs3779547 |
| 156 | ORF132_7_117292584_117297912_117353457_117366529_RF | ASZ1; WNT2; rs114167782; rs749398878; rs3779547 |
| 157 | ORF133_4_151328386_151338975_151358698_151359731_RR | FAM160A1; SH3D19 |
| 158 | ORF133_4_151328386_151338975_151358698_151359731_RR | FAM160A1; SH3D19 |
| 159 | ORF134_6_82026159_82034690_82077947_82085585_RR | IBTK; rs10806235 |
| 160 | ORF134_6_82026159_82034690_82077947_82085585_RR | IBTK; rs10806235 |
| 161 | ORF138_10_104234446_104238473_104264982_104269909_RR | CFAP43; GSTO1; GSTO2; rs11191972; rs4925 |
| 162 | ORF138_10_104234446_104238473_104264982_104269909_RR | CFAP43; GSTO1; GSTO2; rs11191972; rs4925 |
| 163 | ORF138_2_77502067_77504306_77514867_77519288_FR | LRRTM4; rs61354037 |
| 164 | ORF138_2_77502067_77504306_77514867_77519288_FR | LRRTM4; rs61354037 |
| 165 | ORF14_1_76032659_76035831_76077590_76079532_RF | ST6GALNAC3; rs12095069 |
| 166 | ORF14_1_76032659_76035831_76077590_76079532_RF | ST6GALNAC3; rs12095069 |
| 167 | ORF14_1_8423193_8424500_8478289_8482650_FR | RERE; rs301807; rs301797; rs301798; rs172531; rs34976449; rs301819; rs159963; rs142472947; rs4908760; rs301806 |
| 168 | ORF14_1_8423193_8424500_8478289_8482650_FR | RERE; rs301807; rs301797; rs301798; rs172531; rs34976449; rs301819; rs159963; rs142472947; rs4908760; rs301806 |
| 169 | ORF14_10_97762614_97766905_97790822_97793778_RF | SFRP5; ZFYVE27; rs7072751 |
| 170 | ORF14_10_97762614_97766905_97790822_97793778_RF | SFRP5; ZFYVE27; rs7072751 |
| 171 | ORF14_12_75070822_75072825_75141366_75143140_FF | CAPS2; KCNC2 |
| 172 | ORF14_12_75070822_75072825_75141366_75143140_FF | CAPS2; KCNC2 |
| 173 | ORF14_13_51302963_51306635_51323631_51326485_RR | FAM124A; SERPINE3 |
| 174 | ORF14_13_51302963_51306635_51323631_51326485_RR | FAM124A; SERPINE3 |
| 175 | ORF14_15_77328486_77331349_77382463_77385598_RR | HMG20A; PEAK1 |
| 176 | ORF14_15_77328486_77331349_77382463_77385598_RR | HMG20A; PEAK1 |
| 177 | ORF14_19_56921649_56925569_56987150_56988841_FR | USP29; ZIM2 |

TABLE 3.b1-continued

| | Probe | GeneLocus |
|---|---|---|
| 178 | ORF14_19_56921649_56925569_56987150_56988841_FR | USP29; ZIM2 |
| 179 | ORF14_3_105431137_105438494_105503436_105507339_FF | ALCAM; rs13070790 |
| 180 | ORF14_3_105431137_105438494_105503436_105507339_FF | ALCAM; rs13070790 |
| 181 | ORF14_3_16438382_16444965_16476728_16479586_FF | RFTN1; rs3856834 |
| 182 | ORF14_3_16438382_16444965_16476728_16479586_FF | RFTN1; rs3856834 |
| 183 | ORF14_4_125340607_125343598_125392915_125397466_RR | FAT4; rs1039808 |
| 184 | ORF14_4_125340607_125343598_125392915_125397466_RR | FAT4; rs1039808 |
| 185 | ORF14_6_168789036_168790083_168918636_168926703_RR | rs196458; rs116146467 |
| 186 | ORF14_6_168789036_168790083_168918636_168926703_RR | rs196458; rs116146467 |
| 187 | ORF14_8_109580000_109582610_109632260_109640195_RF | EBAG9; SYBU |
| 188 | ORF14_8_109580000_109582610_109632260_109640195_RF | EBAG9; SYBU |
| 189 | ORF14_8_28471461_28475878_28536205_28541536_FR | FBXO16; FZD3; rs17059209 |
| 190 | ORF14_8_28471461_28475878_28536205_28541536_FR | FBXO16; FZD3; rs17059209 |
| 191 | ORF14_X_111096546_111110500_111165610_111175893_FF | PAK3; rs121434612; rs780775497; rs121434613 |
| 192 | ORF14_X_111096546_111110500_111165610_111175893_FF | PAK3; rs121434612; rs780775497; rs121434613 |
| 193 | ORF140_2_38110623_38114294_38179203_38180978_FR | ATL2; CYP1B1 |
| 194 | ORF140_2_38110623_38114294_38179203_38180978_FR | ATL2; CYP1B1 |
| 195 | ORF141_6_115981175_115984851_116074475_116077750_FF | FRK; NT5DC1; rs1933737; rs9488822; rs3822857; rs868943; rs6909746; rs1999930 |
| 196 | ORF141_6_115981175_115984851_116074475_116077750_FF | FRK; NT5DC1; rs1933737; rs9488822; rs3822857; rs868943; rs6909746; rs1999930 |
| 197 | ORF142_2_38110623_38114294_38179203_38180978_FF | ATL2; CYP1B1 |
| 198 | ORF142_2_38110623_38114294_38179203_38180978_FF | ATL2; CYP1B1 |
| 199 | ORF142_8_22647922_22651917_22671292_22674484_FF | BIN3; EGR3; rs2280104 |
| 200 | ORF142_8_22647922_22651917_22671292_22674484_FF | BIN3; EGR3; rs2280104 |
| 201 | ORF144_11_133321952_133325802_133378245_133382756_FR | OPCML; rs7104890; rs4379857 |
| 202 | ORF144_11_133321952_133325802_133378245_133382756_FR | OPCML; rs7104890; rs4379857 |
| 203 | ORF144_13_32247490_32254361_32296396_32300347_RR | FRY; ZAR1L; rs56404467; rs56084662 |
| 204 | ORF144_13_32247490_32254361_32296396_32300347_RR | FRY; ZAR1L; rs56404467; rs56084662 |
| 205 | ORF147_2_102946170_102956566_102983000_102995309_FR | TMEM182; rs12105421 |
| 206 | ORF147_2_102946170_102956566_102983000_102995309_FR | TMEM182; rs12105421 |
| 207 | ORF148_3_65827279_65831993_65898255_65903690_RF | MAGI1; rs145965284 |
| 208 | ORF148_3_65827279_65831993_65898255_65903690_RF | MAGI1; rs145965284 |
| 209 | ORF149_14_68260022_68266399_68325745_68327713_RF | RAD51B; rs17105278; rs4902562; rs3784099; rs2208397; rs911263; rs2104047; rs1950897; rs11158728; rs927220; rs61985136; rs8017304; rs1956529; rs4902566; rs1570106 |
| 210 | ORF149_14_68260022_68266399_68325745_68327713_RF | RAD51B; rs17105278; rs4902562; rs3784099; rs2208397; rs911263; rs2104047; rs1950897; rs11158728; rs927220; rs61985136; rs8017304; rs1956529; rs4902566; rs1570106 |
| 211 | ORF15_1_13945271_13952984_14001723_14008533_FF | rs7542939 |
| 212 | ORF15_1_13945271_13952984_14001723_14008533_FF | rs7542939 |
| 213 | ORF15_10_121564423_121570750_121690817_121692131_FR | FGFR2; rs148514974; rs10510097; rs4752569; rs3750817; rs7895676; rs10736303; rs11200014; rs2981579; rs1078806; rs2981578; rs35054928; rs2981575; rs1219648; rs1219642; rs2912774; rs2936870; rs45631563; rs2420946; rs3135724; rs2981582; rs3135718; rs1219515; rs1696803; rs755001161 |
| 214 | ORF15_10_121564423_121570750_121690817_121692131_FR | FGFR2; rs148514974; rs10510097; rs4752569; rs3750817; rs7895676; rs10736303; rs11200014; rs2981579; rs1078806; rs2981578; rs35054928; rs2981575; rs1219648; rs1219642; rs2912774; rs2936870; rs45631563; rs2420946; rs3135724; rs2981582; rs3135718; rs1219515; rs1696803; rs755001161 |
| 215 | ORF15_10_25034559_25040591_25081322_25084214_RF | ENKUR; THNSL1 |
| 216 | ORF15_10_25034559_25040591_25081322_25084214_RF | ENKUR; THNSL1 |
| 217 | ORF15_10_76410191_76412075_76458091_76462498_FR | C10orf11; rs11593840; rs10509373 |
| 218 | ORF15_10_76410191_76412075_76458091_76462498_FR | C10orf11; rs11593840; rs10509373 |
| 219 | ORF15_12_10096371_10100557_10157054_10158072_RF | CLEC1A; CLEC7A; OLR1; rs16910526; rs16910527; rs7309123; rs2078178; rs3901533 |
| 220 | ORF15_12_10096371_10100557_10157054_10158072_RF | CLEC1A; CLEC7A; OLR1; rs16910526; rs16910527; rs7309123; rs2078178; rs3901533 |

TABLE 3.b2

| | Probe_Count_Total | Probe_Count_Sig | HyperG_Stats |
|---|---|---|---|
| 111 | 110; NA | 2; 1; NA | 0.124006577; 0.042275815; NA |
| 112 | 110; NA | 2; 1; NA | 0.124006577; 0.042275815; NA |
| 113 | 98; 77; NA | 1; 2; 1; 2; NA | 0.080334308; 0.135364458; 0.14587104; 0.206032338; NA |
| 114 | 98; 77; NA | 1; 2; 1; 2; NA | 0.080334308; 0.135364458; 0.14587104; 0.206032338; NA |

TABLE 3.b2-continued

| | Probe_Count_Total | Probe_Count_Sig | HyperG_Stats |
|---|---|---|---|
| 115 | 53; NA | 1; 1; NA | 0.261255041; 0.238249082; NA |
| 116 | 53; NA | 1; 1; NA | 0.261255041; 0.238249082; NA |
| 117 | 7; 7; NA | 1; 1; 1; 1; NA | 0.215038813; 0.227740664; 0.215038813; 0.227740664; NA |
| 118 | 7; 7; NA | 1; 1; 1; 1; NA | 0.215038813; 0.227740664; 0.215038813; 0.227740664; NA |
| 119 | NA | NA | NA |
| 120 | NA | NA | NA |
| 121 | 16; NA | 1; 2; NA | 0.343724359; 0.116490918; NA |
| 122 | 16; NA | 1; 2; NA | 0.343724359; 0.116490918; NA |
| 123 | 6; NA | 1; 1; NA | 0.191789359; 0.203777963; NA |
| 124 | 6; NA | 1; 1; NA | 0.191789359; 0.203777963; NA |
| 125 | 62; NA | 3; 3; NA | 0.214894644; 0.223472567; NA |
| 126 | 62; NA | 3; 3; NA | 0.214894644; 0.223472567; NA |
| 127 | 65; NA | 1; 1; NA | 0.198659276; 0.174214187; NA |
| 128 | 65; NA | 1; 1; NA | 0.198659276; 0.174214187; NA |
| 129 | 49; 58; NA | 1; 1; 1; 1; NA | 0.283240383; 0.261686551; 0.234279681; 0.210195578; NA |
| 130 | 49; 58; NA | 1; 1; 1; 1; NA | 0.283240383; 0.261686551; 0.234279681; 0.210195578; NA |
| 131 | 30; 50 | 1; 1; 1; 1 | 0.36936157; 0.363021342; 0.277739605; 0.255769837 |
| 132 | 30; 50 | 1; 1; 1; 1 | 0.36936157; 0.363021342; 0.277739605; 0.255769837 |
| 133 | 22; 22; 16 | 1; 1; 1; 1; 1; 1 | 0.372324987; 0.375573766; 0.372324987; 0.375573766; 0.343724359; 0.353547066 |
| 134 | 22; 22; 16 | 1; 1; 1; 1; 1; 1 | 0.372324987; 0.375573766; 0.372324987; 0.375573766; 0.343724359; 0.353547066 |
| 135 | 190; NA | 5; 4; NA | 0.112399625; 0.054978865; NA |
| 136 | 190; NA | 5; 4; NA | 0.112399625; 0.054978865; NA |
| 137 | 5; NA | 1; 1; NA | 0.166301763; 0.177271291; NA |
| 138 | 5; NA | 1; 1; NA | 0.166301763; 0.177271291; NA |
| 139 | 7; 50; NA | 1; 1; 3; 3; NA | 0.215038813; 0.227740664; 0.179388457; 0.193973801; NA |
| 140 | 7; 50; NA | 1; 1; 3; 3; NA | 0.215038813; 0.227740664; 0.179388457; 0.193973801; NA |
| 141 | 62; NA | 3; 3; NA | 0.214894644; 0.223472567; NA |
| 142 | 62; NA | 3; 3; NA | 0.214894644; 0.223472567; NA |
| 143 | 59; 59; NA | 1; 1; 1; 1; NA | 0.229012733; 0.204801276; 0.229012733; 0.204801276; NA |
| 144 | 59; 59; NA | 1; 1; 1; 1; NA | 0.229012733; 0.204801276; 0.229012733; 0.204801276; NA |
| 145 | 40; NA | 2; 3; NA | 0.261899069; 0.150241062; NA |
| 146 | 40; NA | 2; 3; NA | 0.261899069; 0.150241062; NA |
| 147 | NA | NA | NA |
| 148 | NA | NA | NA |
| 149 | 34; 34 | 1; 1; 1; 1 | 0.357029649; 0.346365974; 0.357029649; 0.346365974 |
| 150 | 34; 34 | 1; 1; 1; 1 | 0.357029649; 0.346365974; 0.357029649; 0.346365974 |
| 151 | 15; NA | 1; 1; NA | 0.335307856; 0.346011739; NA |
| 152 | 15; NA | 1; 1; NA | 0.335307856; 0.346011739; NA |
| 153 | 50; 120; NA | 1; 1; 1; 1; NA | 0.277739605; 0.255769837; 0.040862114; 0.029934241; NA |
| 154 | 50; 120; NA | 1; 1; 1; 1; NA | 0.277739605; 0.255769837; 0.040862114; 0.029934241; NA |
| 155 | 23; 23; NA | 2; 2; 2; 2; NA | 0.166907425; 0.181828486; 0.166907425; 0.181828486; NA |
| 156 | 23; 23; NA | 2; 2; 2; 2; NA | 0.166907425; 0.181828486; 0.166907425; 0.181828486; NA |
| 157 | 9; 14 | 1; 1; 1; 1 | 0.255358235; 0.268692312; 0.325643034; 0.337131196 |
| 158 | 9; 14 | 1; 1; 1; 1 | 0.255358235; 0.268692312; 0.325643034; 0.337131196 |
| 159 | 15; NA | 2; 1; NA | 0.095167761; 0.346011739; NA |
| 160 | 15; NA | 2; 1; NA | 0.095167761; 0.346011739; NA |
| 161 | 36; 36; 26; NA | 1; 1; 1; 1; 1; 1; NA | 0.349116343; 0.336492635; 0.349116343; 0.336492635; 0.375314357; 0.373699919; NA |
| 162 | 36; 36; 26; NA | 1; 1; 1; 1; 1; 1; NA | 0.349116343; 0.336492635; 0.349116343; 0.336492635; 0.375314357; 0.373699919; NA |
| 163 | 9; NA | 3; 2; NA | 0.00391071; 0.047199169; NA |
| 164 | 9; NA | 3; 2; NA | 0.00391071; 0.047199169; NA |
| 165 | 45; NA | 5; 5; NA | 0.022343156; 0.028833151; NA |
| 166 | 45; NA | 5; 5; NA | 0.022343156; 0.028833151; NA |
| 167 | 16; NA | 2; 1; NA | 0.104530159; 0.353547066; NA |
| 168 | 16; NA | 2; 1; NA | 0.104530159; 0.353547066; NA |
| 169 | 26; 28; NA | 1; 1; 1; 1; NA | 0.375314357; 0.373699919; 0.373281001; 0.369266824; NA |
| 170 | 26; 28; NA | 1; 1; 1; 1; NA | 0.375314357; 0.373699919; 0.373281001; 0.369266824; NA |
| 171 | 13; 13 | 4; 4; 4; 4 | 0.001148684; 0.001517434; 0.001148684; 0.001517434 |
| 172 | 13; 13 | 4; 4; 4; 4 | 0.001148684; 0.001517434; 0.001148684; 0.001517434 |
| 173 | 40; 43 | 2; 2; 2; 2 | 0.261899069; 0.269983451; 0.269116178; 0.27473038 |
| 174 | 40; 43 | 2; 2; 2; 2 | 0.261899069; 0.269983451; 0.269116178; 0.27473038 |
| 175 | 38; 9 | 1; 1; 1; 1 | 0.340322106; 0.325888812; 0.255358235; 0.268692312 |
| 176 | 38; 9 | 1; 1; 1; 1 | 0.340322106; 0.325888812; 0.255358235; 0.268692312 |
| 177 | 24; 28 | 1; 1; 1; 1 | 0.375122937; 0.375945017; 0.373281001; 0.369266824 |
| 178 | 24; 28 | 1; 1; 1; 1 | 0.375122937; 0.375945017; 0.373281001; 0.369266824 |
| 179 | 5; NA | 1; 1; NA | 0.166301763; 0.177271291; NA |
| 180 | 5; NA | 1; 1; NA | 0.166301763; 0.177271291; NA |
| 181 | 55; NA | 2; 3; NA | 0.274632664; 0.209439509; NA |
| 182 | 55; NA | 2; 3; NA | 0.274632664; 0.209439509; NA |
| 183 | 19; NA | 3; 4; NA | 0.030348034; 0.006361707; NA |
| 184 | 19; NA | 3; 4; NA | 0.030348034; 0.006361707; NA |
| 185 | NA | NA | NA |
| 186 | NA | NA | NA |
| 187 | 4; 4 | 1; 1; 1; 1 | 0.138432982; 0.14804367; 0.138432982; 0.14804367 |
| 188 | 4; 4 | 1; 1; 1; 1 | 0.138432982; 0.14804367; 0.138432982; 0.14804367 |

TABLE 3.b2-continued

| | Probe_Count_Total | Probe_Count_Sig | HyperG_Stats |
|---|---|---|---|
| 189 | 63; 57; NA | 3; 3; 3; 3; NA | 0.216848517; 0.224771745; 0.202795213; 0.214348844; NA |
| 190 | 63; 57; NA | 3; 3; 3; 3; NA | 0.216848517; 0.224771745; 0.202795213; 0.214348844; NA |
| 191 | 7; NA | 1; 1; NA | 0.215038813; 0.227740664; NA |
| 192 | 7; NA | 1; 1; NA | 0.215038813; 0.227740664; NA |
| 193 | 23; 34 | 4; 3; 4; 3 | 0.009574125; 0.055866229; 0.0324282; 0.117734198 |
| 194 | 23; 34 | 4; 3; 4; 3 | 0.009574125; 0.055866229; 0.0324282; 0.117734198 |
| 195 | 28; 28; NA | 3; 2; 2; 1; NA | 0.071800115; 0.219149094; 0.204457601; 0.369266824; NA |
| 196 | 28; 28; NA | 3; 2; 2; 1; NA | 0.071800115; 0.219149094; 0.204457601; 0.369266824; NA |
| 197 | 23; 34 | 4; 3; 4; 3 | 0.009574125; 0.055866229; 0.0324282; 0.117734198 |
| 198 | 23; 34 | 4; 3; 4; 3 | 0.009574125; 0.055866229; 0.0324282; 0.117734198 |
| 199 | 20; 57; NA | 1; 1; 1; 1; NA | 0.366490901; 0.372098641; 0.239596043; 0.215667339; NA |
| 200 | 20; 57; NA | 1; 1; 1; 1; NA | 0.366490901; 0.372098641; 0.239596043; 0.215667339; NA |
| 201 | 14; NA | 1; 1; NA | 0.325643034; 0.337131196; NA |
| 202 | 14; NA | 1; 1; NA | 0.325643034; 0.337131196; NA |
| 203 | 12; 12; NA | 1; 1; 1; 1; NA | 0.302214299; 0.314913912; 0.302214299; 0.314913912; NA |
| 204 | 12; 12; NA | 1; 1; 1; 1; NA | 0.302214299; 0.314913912; 0.302214299; 0.314913912; NA |
| 205 | 27; NA | 2; 3; NA | 0.197546356; 0.077717327; NA |
| 206 | 27; NA | 2; 3; NA | 0.197546356; 0.077717327; NA |
| 207 | 55; NA | 5; 5; NA | 0.042810093; 0.05348201; NA |
| 208 | 55; NA | 5; 5; NA | 0.042810093; 0.05348201; NA |
| 209 | 17; NA | 3; 2; NA | 0.023054538; 0.126473611; NA |
| 210 | 17; NA | 3; 2; NA | 0.023054538; 0.126473611; NA |
| 211 | NA | NA | NA |
| 212 | NA | NA | NA |
| 213 | 190; NA | 5; 4; NA | 0.112399625; 0.054978865; NA |
| 214 | 190; NA | 5; 4; NA | 0.112399625; 0.054978865; NA |
| 215 | 43; 17 | 1; 1; 1; 1 | 0.315614698; 0.297350686; 0.350975055; 0.359834557 |
| 216 | 43; 17 | 1; 1; 1; 1 | 0.315614698; 0.297350686; 0.350975055; 0.359834557 |
| 217 | 76; NA | 4; 4; NA | 0.169506823; 0.182516854; NA |
| 218 | 76; NA | 4; 4; NA | 0.169506823; 0.182516854; NA |
| 219 | 44; 68; 79; NA | 2; 2; 2; 2; 2; 3; NA | 0.270943694; 0.275697963; 0.251156755; 0.236353672; 0.219227; 0.224909805; NA |
| 220 | 44; 68; 79; NA | 2; 2; 2; 2; 2; 3; NA | 0.270943694; 0.275697963; 0.251156755; 0.236353672; 0.219227; 0.224909805; NA |

TABLE 3.b3

| | FDR_HyperG | Percent_Sig | logFC | AveExpr |
|---|---|---|---|---|
| 111 | 0.375519541; 0.376115439; NA | 1.82; 0.91; NA | −0.777510613 | −0.777510613 |
| 112 | 0.375519541; 0.376115439; NA | 1.82; 0.91; NA | −0.685826949 | −0.685826949 |
| 113 | 0.375519541; 0.376115439; 0.375519541; 0.376115439; NA | 1.02; 2.04; 1.3; 2.6; NA | −0.852472454 | −0.852472454 |
| 114 | 0.375519541; 0.376115439; 0.375519541; 0.376115439; NA | 1.02; 2.04; 1.3; 2.6; NA | −0.682585961 | −0.682585961 |
| 115 | 0.375519541; 0.376115439; NA | 1.89; 1.89; NA | −1.389617965 | −1.389617965 |
| 116 | 0.375519541; 0.376115439; NA | 1.89; 1.89; NA | −1.204568555 | −1.204568555 |
| 117 | 0.375519541; 0.376115439; 0.375519541; 0.376115439; NA | 14.29; 14.29; 14.29; 14.29; NA | −0.883824041 | −0.883824041 |
| 118 | 0.375519541; 0.376115439; 0.375519541; 0.376115439; NA | 14.29; 14.29; 14.29; 14.29; NA | −0.788321151 | −0.788321151 |
| 119 | NA | NA | −0.811021207 | −0.811021207 |
| 120 | NA | NA | −0.737688212 | −0.737688212 |
| 121 | 0.375519541; 0.376115439; NA | 6.25; 12.5; NA | −1.087081052 | −1.087081052 |
| 122 | 0.375519541; 0.376115439; NA | 6.25; 12.5; NA | −0.983682494 | −0.983682494 |
| 123 | 0.375519541; 0.376115439; NA | 16.67; 16.67; NA | −0.927138124 | −0.927138124 |
| 124 | 0.375519541; 0.376115439; NA | 16.67; 16.67; NA | −0.77161289 | −0.77161289 |
| 125 | 0.375519541; 0.376115439; NA | 4.84; 4.84; NA | −0.767302384 | −0.767302384 |
| 126 | 0.375519541; 0.376115439; NA | 4.84; 4.84; NA | −0.699515795 | −0.699515795 |
| 127 | 0.375519541; 0.376115439; NA | 1.54; 1.54; NA | −1.110094335 | −1.110094335 |
| 128 | 0.375519541; 0.376115439; NA | 1.54; 1.54; NA | −0.994718551 | −0.994718551 |
| 129 | 0.375519541; 0.376115439; 0.375519541; 0.376115439; NA | 2.04; 2.04; 1.72; 1.72; NA | −1.013993605 | −1.013993605 |
| 130 | 0.375519541; 0.376115439; 0.375519541; 0.376115439; NA | 2.04; 2.04; 1.72; 1.72; NA | −1.006858381 | −1.006858381 |
| 131 | 0.375519541; 0.376115439; 0.375519541; 0.376115439 | 3.33; 3.33; 2; 2 | −1.047126655 | −1.047126655 |
| 132 | 0.375519541; 0.376115439; 0.375519541; 0.376115439 | 3.33; 3.33; 2; 2 | −0.99558333 | −0.99558333 |
| 133 | 0.375519541; 0.376115439; 0.375519541; 0.376115439; 0.375519541; 0.376115439 | 4.55; 4.55; 4.55; 4.55; 6.25; 6.25 | −1.210660143 | −1.210660143 |
| 134 | 0.375519541; 0.376115439; 0.375519541; 0.376115439; 0.375519541; 0.376115439 | 4.55; 4.55; 4.55; 4.55; 6.25; 6.25 | −0.671308166 | −0.671308166 |
| 135 | 0.375519541; 0.376115439; NA | 2.63; 2.11; NA | −1.140580782 | −1.140580782 |
| 136 | 0.375519541; 0.376115439; NA | 2.63; 2.11; NA | −0.98447572 | −0.98447572 |
| 137 | 0.375519541; 0.376115439; NA | 20; 20; NA | −0.925553319 | −0.925553319 |
| 138 | 0.375519541; 0.376115439; NA | 20; 20; NA | −0.748812856 | −0.748812856 |

TABLE 3.b3-continued

| | FDR_HyperG | Percent_Sig | logFC | AveExpr |
|---|---|---|---|---|
| 139 | 0.375519541; 0.376115439; 0.375519541; 0.376115439; NA | 14.29; 14.29; 6; 6; NA | −0.886153821 | −0.886153821 |
| 140 | 0.375519541; 0.376115439; 0.375519541; 0.376115439; NA | 14.29; 14.29; 6; 6; NA | −0.825853554 | −0.825853554 |
| 141 | 0.375519541; 0.376115439; NA | 4.84; 4.84; NA | −1.022291185 | −1.022291185 |
| 142 | 0.375519541; 0.376115439; NA | 4.84; 4.84; NA | −0.971200444 | −0.971200444 |
| 143 | 0.375519541; 0.376115439; 0.375519541; 0.376115439; NA | 1.69; 1.69; 1.69; 1.69; NA | −1.07634228 | −1.07634228 |
| 144 | 0.375519541; 0.376115439; 0.375519541; 0.376115439; NA | 1.69; 1.69; 1.69; 1.69; NA | −0.949556179 | −0.949556179 |
| 145 | 0.375519541; 0.376115439; NA | 5; 7.5; NA | −0.873348319 | −0.873348319 |
| 146 | 0.375519541; 0.376115439; NA | 5; 7.5; NA | −0.775572344 | −0.775572344 |
| 147 | NA | NA | −0.805004033 | −0.805004033 |
| 148 | NA | NA | −0.674883638 | −0.674883638 |
| 149 | 0.375519541; 0.376115439; 0.375519541; 0.376115439 | 2.94; 2.94; 2.94; 2.94 | −0.786545722 | −0.786545722 |
| 150 | 0.375519541; 0.376115439; 0.375519541; 0.376115439 | 2.94; 2.94; 2.94; 2.94 | −0.624964577 | −0.624964577 |
| 151 | 0.375519541; 0.376115439; NA | 6.67; 6.67; NA | −0.915929727 | −0.915929727 |
| 152 | 0.375519541; 0.376115439; NA | 6.67; 6.67; NA | −0.885925031 | −0.885925031 |
| 153 | 0.375519541; 0.376115439; 0.375519541; 0.376115439; NA | 2; 2; 0.83; 0.83; NA | −1.112146797 | −1.112146797 |
| 154 | 0.375519541; 0.376115439; 0.375519541; 0.376115439; NA | 2; 2; 0.83; 0.83; NA | −1.081744184 | −1.081744184 |
| 155 | 0.375519541; 0.376115439; 0.375519541; 0.376115439; NA | 8.7; 8.7; 8.7; 8.7; NA | −1.227274379 | −1.227274379 |
| 156 | 0.375519541; 0.376115439; 0.375519541; 0.376115439; NA | 8.7; 8.7; 8.7; 8.7; NA | −1.032857203 | −1.032857203 |
| 157 | 0.375519541; 0.376115439; 0.375519541; 0.376115439 | 11.11; 11.11; 7.14; 7.14 | −1.365554559 | −1.365554559 |
| 158 | 0.375519541; 0.376115439; 0.375519541; 0.376115439 | 11.11; 11.11; 7.14; 7.14 | −1.205008284 | −1.205008284 |
| 159 | 0.375519541; 0.376115439; NA | 13.33; 6.67; NA | −0.850842245 | −0.850842245 |
| 160 | 0.375519541; 0.376115439; NA | 13.33; 6.67; NA | −0.714977183 | −0.714977183 |
| 161 | 0.375519541; 0.376115439; 0.375519541; 0.376115439; 0.375519541; 0.376115439; NA | 2.78; 2.78; 2.78; 2.78; 3.85; 3.85; NA | −1.450478131 | −1.450478131 |
| 162 | 0.375519541; 0.376115439; 0.375519541; 0.376115439; 0.375519541; 0.376115439; NA | 2.78; 2.78; 2.78; 2.78; 3.85; 3.85; NA | −1.419835202 | −1.419835202 |
| 163 | 0.185936467; 0.376115439; NA | 33.33; 22.22; NA | −1.23642913 | −1.23642913 |
| 164 | 0.185936467; 0.376115439; NA | 33.33; 22.22; NA | −0.989238415 | −0.989238415 |
| 165 | 0.375519541; 0.376115439; NA | 11.11; 11.11; NA | −0.899188624 | −0.899188624 |
| 166 | 0.375519541; 0.376115439; NA | 11.11; 11.11; NA | −0.800106474 | −0.800106474 |
| 167 | 0.375519541; 0.376115439; NA | 12.5; 6.25; NA | −0.963761492 | −0.963761492 |
| 168 | 0.375519541; 0.376115439; NA | 12.5; 6.25; NA | −0.735002844 | −0.735002844 |
| 169 | 0.375519541; 0.376115439; 0.375519541; 0.376115439; NA | 3.85; 3.85; 3.57; 3.57; NA | −1.016353323 | −1.016353323 |
| 170 | 0.375519541; 0.376115439; 0.375519541; 0.376115439; NA | 3.85; 3.85; 3.57; 3.57; NA | −0.803235024 | −0.803235024 |
| 171 | 0.069549998; 0.082088441; 0.069549998; 0.082088441 | 30.77; 30.77; 30.77; 30.77 | −1.067563562 | −1.067563562 |
| 172 | 0.069549998; 0.082088441; 0.069549998; 0.082088441 | 30.77; 30.77; 30.77; 30.77 | −0.812353607 | −0.812353607 |
| 173 | 0.375519541; 0.376115439; 0.375519541; 0.376115439 | 5; 5; 4.65; 4.65 | −0.884025289 | −0.884025289 |
| 174 | 0.375519541; 0.376115439; 0.375519541; 0.376115439 | 5; 5; 4.65; 4.65 | −0.825481583 | −0.825481583 |
| 175 | 0.375519541; 0.376115439; 0.375519541; 0.376115439 | 2.63; 2.63; 11.11; 11.11 | −0.967126149 | −0.967126149 |
| 176 | 0.375519541; 0.376115439; 0.375519541; 0.376115439 | 2.63; 2.63; 11.11; 11.11 | −0.956368249 | −0.956368249 |
| 177 | 0.375519541; 0.376115439; 0.375519541; 0.376115439 | 4.17; 4.17; 3.57; 3.57 | −1.203240678 | −1.203240678 |
| 178 | 0.375519541; 0.376115439; 0.375519541; 0.376115439 | 4.17; 4.17; 3.57; 3.57 | −1.174006458 | −1.174006458 |
| 179 | 0.375519541; 0.376115439; NA | 20; 20; NA | −0.792368549 | −0.792368549 |
| 180 | 0.375519541; 0.376115439; NA | 20; 20; NA | −0.778935979 | −0.778935979 |
| 181 | 0.375519541; 0.376115439; NA | 3.64; 5.45; NA | −1.148262216 | −1.148262216 |
| 182 | 0.375519541; 0.376115439; NA | 3.64; 5.45; NA | −1.10801826 | −1.10801826 |
| 183 | 0.375519541; 0.217379602; NA | 15.79; 21.05; NA | −1.414344323 | −1.414344323 |
| 184 | 0.375519541; 0.217379602; NA | 15.79; 21.05; NA | −1.36499136 | −1.36499136 |
| 185 | NA | NA | −0.855173127 | −0.855173127 |
| 186 | NA | NA | −0.801464774 | −0.801464774 |
| 187 | 0.375519541; 0.376115439; 0.375519541; 0.376115439 | 25; 25; 25; 25 | −0.734170577 | −0.734170577 |
| 188 | 0.375519541; 0.376115439; 0.375519541; 0.376115439 | 25; 25; 25; 25 | −0.733715768 | −0.733715768 |
| 189 | 0.375519541; 0.376115439; 0.375519541; 0.376115439; NA | 4.76; 4.76; 5.26; 5.26; NA | −1.365740534 | −1.365740534 |
| 190 | 0.375519541; 0.376115439; 0.375519541; 0.376115439; NA | 4.76; 4.76; 5.26; 5.26; NA | −1.301686755 | −1.301686755 |
| 191 | 0.375519541; 0.376115439; NA | 14.29; 14.29; NA | −1.016684978 | −1.016684978 |
| 192 | 0.375519541; 0.376115439; NA | 14.29; 14.29; NA | −0.962834673 | −0.962834673 |
| 193 | 0.357661967; 0.376115439; 0.375519541; 0.376115439 | 17.39; 13.04; 11.76; 8.82 | −1.103935035 | −1.103935035 |
| 194 | 0.357661967; 0.376115439; 0.375519541; 0.376115439 | 17.39; 13.04; 11.76; 8.82 | −0.986266284 | −0.986266284 |

TABLE 3.b3-continued

| | FDR_HyperG | Percent_Sig | logFC | AveExpr |
|---|---|---|---|---|
| 195 | 0.375519541; 0.376115439; 0.375519541; 0.376115439; NA | 10.71; 7.14; 7.14; 3.57; NA | −0.991528799 | −0.991528799 |
| 196 | 0.375519541; 0.376115439; 0.375519541; 0.376115439; NA | 10.71; 7.14; 7.14; 3.57; NA | −0.972344962 | −0.972344962 |
| 197 | 0.357661967; 0.376115439; 0.375519541; 0.376115439 | 17.39; 13.04; 11.76; 8.82 | −1.061516657 | −1.061516657 |
| 198 | 0.357661967; 0.376115439; 0.375519541; 0.376115439 | 17.39; 13.04; 11.76; 8.82 | −0.928465595 | −0.928465595 |
| 199 | 0.375519541; 0.376115439; 0.375519541; 0.376115439; NA | 5; 5; 1.75; 1.75; NA | −1.376546241 | −1.376546241 |
| 200 | 0.375519541; 0.376115439; 0.375519541; 0.376115439; NA | 5; 5; 1.75; 1.75; NA | −1.257571903 | −1.257571903 |
| 201 | 0.375519541; 0.376115439; NA | 7.14; 7.14; NA | −0.876775257 | −0.876775257 |
| 202 | 0.375519541; 0.376115439; NA | 7.14; 7.14; NA | −0.689672422 | −0.689672422 |
| 203 | 0.375519541; 0.376115439; 0.375519541; 0.376115439; NA | 8.33; 8.33; 8.33; 8.33; NA | −0.925255622 | −0.925255622 |
| 204 | 0.375519541; 0.376115439; 0.375519541; 0.376115439; NA | 8.33; 8.33; 8.33; 8.33; NA | −0.824269098 | −0.824269098 |
| 205 | 0.375519541; 0.376115439; NA | 7.41; 11.11; NA | −1.022231252 | −1.022231252 |
| 206 | 0.375519541; 0.376115439; NA | 7.41; 11.11; NA | −0.843090271 | −0.843090271 |
| 207 | 0.375519541; 0.376115439; NA | 9.09; 9.09; NA | −0.97363056 | −0.97363056 |
| 208 | 0.375519541; 0.376115439; NA | 9.09; 9.09; NA | −0.873957515 | −0.873957515 |
| 209 | 0.375519541; 0.376115439; NA | 17.65; 11.76; NA | −1.04545911 | −1.04545911 |
| 210 | 0.375519541; 0.376115439; NA | 17.65; 11.76; NA | −0.824222551 | −0.824222551 |
| 211 | NA | NA | −0.977373447 | −0.977373447 |
| 212 | NA | NA | −0.842420208 | −0.842420208 |
| 213 | 0.375519541; 0.376115439; NA | 2.63; 2.11; NA | −0.941968114 | −0.941968114 |
| 214 | 0.375519541; 0.376115439; NA | 2.63; 2.11; NA | −0.862034178 | −0.862034178 |
| 215 | 0.375519541; 0.376115439; 0.375519541; 0.376115439 | 2.33; 2.33; 5.88; 5.88 | −1.086078797 | −1.086078797 |
| 216 | 0.375519541; 0.376115439; 0.375519541; 0.376115439 | 2.33; 2.33; 5.88; 5.88 | −0.841320836 | −0.841320836 |
| 217 | 0.375519541; 0.376115439; NA | 5.26; 5.26; NA | −0.834126422 | −0.834126422 |
| 218 | 0.375519541; 0.376115439; NA | 5.26; 5.26; NA | −0.728967849 | −0.728967849 |
| 219 | 0.375519541; 0.376115439; 0.375519541; 0.376115439; 0.375519541; 0.376115439; NA | 4.55; 4.55; 2.94; 2.94; 2.53; 3.8; NA | −0.835114867 | −0.835114867 |
| 220 | 0.375519541; 0.376115439; 0.375519541; 0.376115439; 0.375519541; 0.376115439; NA | 4.55; 4.55; 2.94; 2.94; 2.53; 3.8; NA | −0.72611581 | −0.72611581 |

TABLE 3.b4

| | T | P.Value | adj.P.Val | B | FC | FC_1 | LS |
|---|---|---|---|---|---|---|---|
| 111 | −14.36115991 | 0.00000000651 | 0.00000232 | 11.04469924 | 0.583372541 | −1.714170498 | −1 |
| 112 | −9.329465798 | 0.000000786 | 0.0000639 | 6.297164838 | 0.621649397 | −1.608623777 | −1 |
| 113 | −8.14278595 | 0.00000317 | 0.0000822 | 4.822145964 | 0.553834774 | −1.805592654 | −1 |
| 114 | −5.091722152 | 0.000269874 | 0.002916131 | 0.323101255 | 0.623047491 | −1.605014088 | −1 |
| 115 | −7.511428379 | 0.00000719 | 0.000139588 | 3.977752946 | 0.381665857 | −2.620092898 | −1 |
| 116 | −7.717348519 | 0.0000056 | 0.000218549 | 4.300752547 | 0.433899084 | −2.304683364 | −1 |
| 117 | −8.994540631 | 0.00000112 | 0.0000431 | 5.885498394 | 0.541929076 | −1.845259913 | −1 |
| 118 | −7.486625246 | 0.0000076 | 0.000264198 | 3.989176087 | 0.579017497 | −1.727063527 | −1 |
| 119 | −5.953638695 | 0.0000672 | 0.000626595 | 1.668249934 | 0.569978258 | −1.754452887 | −1 |
| 120 | −5.543469094 | 0.000129579 | 0.001748926 | 1.076513756 | 0.599699547 | −1.667501677 | −1 |
| 121 | −10.48148624 | 0.000000218 | 0.0000158 | 7.556007791 | 0.470712787 | −2.124437722 | −1 |
| 122 | −11.23480801 | 0.000000106 | 0.0000191 | 8.304307297 | 0.505687319 | −1.977506579 | −1 |
| 123 | −8.610688483 | 0.00000063 | 0.000108468 | 5.444458359 | 0.525900537 | −1.901500244 | −1 |
| 124 | −13.06779282 | 0.0000000189 | 0.00000399 | 9.99985585 | 0.585762244 | −1.70717729 | −1 |
| 125 | −9.053539931 | 0.00000105 | 0.0000412 | 5.956116526 | 0.58751501 | −1.702084173 | −1 |
| 126 | −9.164417643 | 0.000000949 | 0.0000718 | 6.106390455 | 0.615778843 | −1.623959659 | −1 |
| 127 | −11.73476447 | 0.000000063 | 0.00000752 | 8.805528531 | 0.463263738 | −2.158597614 | −1 |
| 128 | −14.72041303 | 0.00000000515 | 0.000004 | 11.22840766 | 0.501833765 | −1.992691742 | −1 |
| 129 | −9.558295537 | 0.000000608 | 0.0000547 | 6.556892291 | 0.495173631 | −2.019493643 | −1 |
| 130 | −9.075013641 | 0.00000102 | 0.0000406 | 5.981724979 | 0.497628707 | −2.00953037 | −1 |
| 131 | −8.355022506 | 0.000000243 | 0.0000698 | 5.094094747 | 0.483931027 | −2.066410179 | −1 |
| 132 | −12.5435734 | 0.0000000312 | 0.00000985 | 9.501483884 | 0.501533047 | −1.993886557 | −1 |
| 133 | −7.779408145 | 0.00000505 | 0.000111358 | 4.342263898 | 0.432070865 | −2.314435156 | −1 |
| 134 | −4.805075445 | 0.000436255 | 0.004079528 | −0.16923243 | 0.627937046 | −1.592516329 | −1 |
| 135 | −12.40851702 | 0.0000000338 | 0.00000546 | 9.425222726 | 0.453576946 | −2.204697593 | −1 |
| 136 | −13.33417997 | 0.0000000157 | 0.00000701 | 10.16382252 | 0.505409357 | −1.978594155 | −1 |
| 137 | −10.45242145 | 0.000000225 | 0.000016 | 7.525413378 | 0.526478558 | −1.899412587 | −1 |
| 138 | −7.51191533 | 0.00000735 | 0.000258714 | 4.023665668 | 0.595093038 | −1.68040951 | −1 |
| 139 | −8.26991208 | 0.0000027 | 0.0000744 | 4.986224241 | 0.541054631 | −1.848242195 | −1 |
| 140 | −9.859082055 | 0.000000436 | 0.0000447 | 6.890097661 | 0.564148332 | −1.772583457 | −1 |
| 141 | −10.07315497 | 0.000000335 | 0.0000202 | 7.118997831 | 0.492333842 | −2.031142114 | −1 |
| 142 | −18.74359611 | 0.000000000322 | 0.00000121 | 13.75629268 | 0.510081455 | −1.960471194 | −1 |
| 143 | −10.12569182 | 0.000000327 | 0.0000378 | 7.17791162 | 0.474229633 | −2.108683073 | −1 |
| 144 | −6.572087681 | 0.0000266 | 0.00033238 | 2.625216777 | 0.517791727 | −1.931278441 | −1 |

TABLE 3.b4-continued

| | T | P.Value | adj.P.Val | B | FC | FC_1 | LS |
|---|---|---|---|---|---|---|---|
| 145 | −6.81988753 | 0.000019 | 0.000482369 | 3.049127096 | 0.545878462 | −1.831909608 | −1 |
| 146 | −4.815162336 | 0.000424325 | 0.002359018 | −0.233217999 | 0.584156833 | −1.711869047 | −1 |
| 147 | −9.385119881 | 0.000000716 | 0.0000327 | 6.346029874 | 0.57236048 | −1.747150676 | −1 |
| 148 | −9.004759632 | 0.00000114 | 0.0000807 | 5.919040127 | 0.626382739 | −1.596468003 | −1 |
| 149 | −8.671656636 | 0.00000165 | 0.0000548 | 5.492202876 | 0.579730494 | −1.724939452 | −1 |
| 150 | −7.487430405 | 0.00000759 | 0.000264039 | 3.990274418 | 0.648435699 | −1.542172959 | −1 |
| 151 | −7.258163966 | 0.0000103 | 0.000322406 | 3.673793273 | 0.530002207 | −1.886784595 | −1 |
| 152 | −6.431068475 | 0.0000327 | 0.000381029 | 2.411745899 | 0.541140442 | −1.847949115 | −1 |
| 153 | −18.82495171 | 0.000000000306 | 0.00000118 | 13.80026651 | 0.462605141 | −2.161670747 | −1 |
| 154 | −16.80621079 | 0.00000000107 | 0.000000994 | 12.7653672 | 0.472457288 | −2.116593447 | −1 |
| 155 | −7.739344153 | 0.00000532 | 0.000115212 | 4.288348991 | 0.42712363 | −2.34124251 | −1 |
| 156 | −6.391893966 | 0.0000353 | 0.000723569 | 2.413482092 | 0.488741256 | −2.04607241 | −1 |
| 157 | −13.42644648 | 0.0000000139 | 0.0000034 | 10.30011908 | 0.388085232 | −2.57675355 | −1 |
| 158 | −7.042293387 | 0.0000139 | 0.000391456 | 3.369385239 | 0.433766853 | −2.305385931 | −1 |
| 159 | −7.277271387 | 0.00000986 | 0.000172376 | 3.651653273 | 0.554460947 | −1.803553532 | −1 |
| 160 | −16.3013331 | 0.00000000161 | 0.00000232 | 12.3113832 | 0.609214767 | −1.641457257 | −1 |
| 161 | −19.37444065 | 0.000000000219 | 0.00000103 | 14.09090854 | 0.365900139 | −2.732986116 | −1 |
| 162 | −17.42774343 | 0.000000000707 | 0.000000818 | 13.15722335 | 0.373755004 | −2.675549466 | −1 |
| 163 | −7.835349078 | 0.00000469 | 0.000106363 | 4.417206668 | 0.42442186 | −2.356146312 | −1 |
| 164 | −6.398620016 | 0.0000349 | 0.000719449 | 2.423670925 | 0.503743626 | −1.985136779 | −1 |
| 165 | −9.978256334 | 0.000000371 | 0.0000215 | 7.015173256 | 0.5361882 | −1.865016797 | −1 |
| 166 | −12.04374371 | 0.0000000491 | 0.0000125 | 9.059857955 | 0.574306791 | −1.741229628 | −1 |
| 167 | −7.432057605 | 0.000008 | 0.000149619 | 3.86801945 | 0.512718375 | −1.950388456 | −1 |
| 168 | −6.835435792 | 0.0000186 | 0.00047492 | 3.07173748 | 0.60081684 | −1.664400751 | −1 |
| 169 | −7.33146989 | 0.00000916 | 0.000164215 | 3.727772169 | 0.494364371 | −2.022799494 | −1 |
| 170 | −7.94470137 | 0.00000417 | 0.000181823 | 4.60112036 | 0.57306273 | −1.745009661 | −1 |
| 171 | −8.864593817 | 0.00000131 | 0.0000472 | 5.72861235 | 0.477124091 | −2.095890815 | −1 |
| 172 | −5.516165861 | 0.000135344 | 0.001801338 | 1.031785152 | 0.569452098 | −1.756073959 | −1 |
| 173 | −7.28062139 | 0.00001 | 0.000316867 | 3.705101749 | 0.541853485 | −1.845517336 | −1 |
| 174 | −8.609406076 | 0.00000178 | 0.0000574 | 5.415026424 | 0.564293805 | −1.77212649 | −1 |
| 175 | −13.18263612 | 0.0000000179 | 0.00000756 | 10.04015243 | 0.511524005 | −1.954942465 | −1 |
| 176 | −9.29108093 | 0.000000797 | 0.0000348 | 6.236634019 | 0.515352599 | −1.94041905 | −1 |
| 177 | −7.680068446 | 0.00000575 | 0.000121209 | 4.208208069 | 0.434298634 | −2.302563077 | −1 |
| 178 | −8.048087702 | 0.00000366 | 0.000167842 | 4.735566313 | 0.443188866 | −2.256374375 | −1 |
| 179 | −11.73019986 | 0.0000000657 | 0.0000145 | 8.77318977 | 0.577395373 | −1.731915508 | −1 |
| 180 | −8.108654172 | 0.00000331 | 0.0000844 | 4.777761087 | 0.58279646 | −1.715864916 | −1 |
| 181 | −10.6386507 | 0.000000192 | 0.0000276 | 7.712625118 | 0.451168355 | −2.216467511 | −1 |
| 182 | −12.8435874 | 0.000000023 | 0.00000441 | 9.807808076 | 0.463930866 | −2.155493571 | −1 |
| 183 | −8.305275046 | 0.00000265 | 0.000136934 | 5.064329258 | 0.375180221 | −2.665385713 | −1 |
| 184 | −11.46034961 | 0.0000000818 | 0.00000877 | 8.543116287 | 0.388236763 | −2.575747833 | −1 |
| 185 | −7.722119441 | 0.00000544 | 0.000116957 | 4.265107035 | 0.552798986 | −1.808975823 | −1 |
| 186 | −5.626197218 | 0.000113641 | 0.001593899 | 1.211396633 | 0.573766334 | −1.742869771 | −1 |
| 187 | −6.742036766 | 0.0000208 | 0.000283309 | 2.8788032 | 0.601163542 | −1.663440862 | −1 |
| 188 | −9.512868638 | 0.000000639 | 0.0000563 | 6.505766323 | 0.601353088 | −1.662916546 | −1 |
| 189 | −10.78142068 | 0.00000016 | 0.0000131 | 7.867278572 | 0.388035208 | −2.577085735 | −1 |
| 190 | −11.18705796 | 0.000000111 | 0.0000197 | 8.258043755 | 0.405651645 | −2.465169343 | −1 |
| 191 | −12.11903577 | 0.000000044 | 0.00000624 | 9.163137768 | 0.494250737 | −2.02326456 | −1 |
| 192 | −7.926701227 | 0.00000427 | 0.000184673 | 4.57757664 | 0.513047863 | −1.949135886 | −1 |
| 193 | −10.30906949 | 0.00000027 | 0.0000338 | 7.371891113 | 0.465245779 | −2.149401555 | −1 |
| 194 | −9.923834321 | 0.000000394 | 0.0000223 | 6.955238775 | 0.50478247 | −1.981051361 | −1 |
| 195 | −10.10568277 | 0.000000335 | 0.0000381 | 7.15655134 | 0.502944531 | −1.988290833 | −1 |
| 196 | −8.142855314 | 0.00000317 | 0.0000822 | 4.822236021 | 0.509676958 | −1.962027091 | −1 |
| 197 | −9.254589617 | 0.000000831 | 0.0000357 | 6.193932519 | 0.479128104 | −2.087124493 | −1 |
| 198 | −7.604991107 | 0.00000649 | 0.000238631 | 4.149881318 | 0.525416862 | −1.903250681 | −1 |
| 199 | −10.89159511 | 0.000000143 | 0.0000122 | 7.979616717 | 0.385139703 | −2.596460434 | −1 |
| 200 | −10.26639227 | 0.000000282 | 0.0000344 | 7.327031514 | 0.41824729 | −2.390930017 | −1 |
| 201 | −7.266061704 | 0.00001 | 0.000174155 | 3.635861464 | 0.544583336 | −1.836266249 | −1 |
| 202 | −6.713994662 | 0.0000221 | 0.000532452 | 2.894245117 | 0.61999461 | −1.612917248 | −1 |
| 203 | −7.887395661 | 0.00000439 | 0.000101601 | 4.486580906 | 0.526587207 | −1.899020687 | −1 |
| 204 | −8.280045772 | 0.00000273 | 0.000139801 | 5.032433217 | 0.564768254 | −1.770637766 | −1 |
| 205 | −15.53259283 | 0.00000000266 | 0.00000146 | 11.90706034 | 0.492354295 | −2.031057737 | −1 |
| 206 | −10.22567586 | 0.00000295 | 0.0000355 | 7.284072518 | 0.557448228 | −1.793888561 | −1 |
| 207 | −6.687733525 | 0.0000229 | 0.000544781 | 2.855593332 | 0.509222983 | −1.963776249 | −1 |
| 208 | −7.339941465 | 0.00000905 | 0.000162777 | 3.739635067 | 0.545648007 | −1.83268332 | −1 |
| 209 | −8.181096093 | 0.00000309 | 0.000151018 | 4.906595586 | 0.484490704 | −2.06402309 | −1 |
| 210 | −6.462041292 | 0.0000313 | 0.00036911 | 2.458870012 | 0.564786476 | −1.770580639 | −1 |
| 211 | −8.253960116 | 0.00000275 | 0.0000752 | 4.965741833 | 0.507903582 | −1.96887763 | −1 |
| 212 | −11.78427903 | 0.0000000624 | 0.0000139 | 8.823179824 | 0.557707196 | −1.79305558 | −1 |
| 213 | −11.4918894 | 0.0000000824 | 0.0000165 | 8.550125208 | 0.520522303 | −1.921147267 | −1 |
| 214 | −8.485740357 | 0.00000207 | 0.0000631 | 5.260387487 | 0.550176271 | −1.817599292 | −1 |
| 215 | −12.70568263 | 0.0000000259 | 0.00000477 | 9.68797636 | 0.471039909 | −2.122962367 | −1 |
| 216 | −9.726417232 | 0.000000504 | 0.000049 | 6.744262912 | 0.558132346 | −1.791689743 | −1 |
| 217 | −13.56132442 | 0.000000013 | 0.00000631 | 10.34638001 | 0.560922585 | −1.782777208 | −1 |
| 218 | −5.481507636 | 0.000141134 | 0.001057191 | 0.90132511 | 0.603335405 | −1.657452871 | −1 |
| 219 | −6.72055369 | 0.0000219 | 0.000529538 | 2.903883844 | 0.560538407 | −1.783999074 | −1 |
| 220 | −8.251268787 | 0.00000276 | 0.0000753 | 4.962283155 | 0.604529308 | −1.654179518 | −1 |

TABLE 3.b5

| | Loop Detected | Probe sequence 60 mer | Probe Location Chr |
|---|---|---|---|
| 111 | sAD | CCTCTTTTTACATGTCTCCTTTTCCCTCTCGAAGTGACTCACTTCTAAAACTTGGGCTGC (SEQ ID NO: 1904) | 12 |
| 112 | mAD | CCTCTTTTTACATGTCTCCTTTTCCCTCTCGAAGTGACTCACTTCTAAAACTTGGGCTGC (SEQ ID NO: 1904) | 12 |
| 113 | sAD | CAAATATCATTATGTATCTTTTCTGATATCGAGAACCAGATGTTATACTTTGGAGACTCC (SEQ ID NO: 1906) | 6 |
| 114 | mAD | CAAATATCATTATGTATCTTTTCTGATATCGAGAACCAGATGTTATACTTTGGAGACTCC (SEQ ID NO: 1906) | 6 |
| 115 | sAD | GATTAATAGTAACAATAGTAAATAATGCTCGAGTTGTACTAAAAGGGTACTGCTAGTGCC (SEQ ID NO: 1908) | 7 |
| 116 | mAD | GATTAATAGTAACAATAGTAAATAATGCTCGAGTTGTACTAAAAGGGTACTGCTAGTGCC (SEQ ID NO: 1908) | 7 |
| 117 | sAD | CATGTCACTTGTGCCATGTAGCACATGGTCGATACTTATCCACCATGAAGCTTAAGAGAA (SEQ ID NO: 1910) | 21 |
| 118 | mAD | CATGTCACTTGTGCCATGTAGCACATGGTCGATACTTATCCACCATGAAGCTTAAGAGAA (SEQ ID NO: 1910) | 21 |
| 119 | sAD | TTGGAACTACTTCTTAGGACCTTAAATTTCGAAACATGGTTGAAAGCTTTCTGACAGAGC (SEQ ID NO: 1912) | 10 |
| 120 | mAD | TTGGAACTACTTCTTAGGACCTTAAATTTCGAAACATGGTTGAAAGCTTTCTGACAGAGC (SEQ ID NO: 1912) | 10 |
| 121 | sAD | ATGCTAAATTATGTAAAATGGAATATGTTCGAACTAGGCAGTCTGACTTTTCTATGTGTG (SEQ ID NO: 1914) | 5 |
| 122 | mAD | ATGCTAAATTATGTAAAATGGAATATGTTCGAACTAGGCAGTCTGACTTTTCTATGTGTG (SEQ ID NO: 1914) | 5 |
| 123 | mAD | ATCATTTTTTTTTCAAGCTTAGCCTCATTCGAGACTGAAATGTTTTTAACAAGGACTTTG (SEQ ID NO: 1916) | 5 |
| 124 | sAD | ATCATTTTTTTTTCAAGCTTAGCCTCATTCGAGACTGAAATGTTTTTAACAAGGACTTTG (SEQ ID NO: 1916) | 5 |
| 125 | sAD | TTCAGTCATTAATGAGTTAATAAAAATCTCGATATTGTTCCTTCCCATGTTTGTAAAAGG (SEQ ID NO: 1918) | 15 |
| 126 | mAD | TTCAGTCATTAATGAGTTAATAAAAATCTCGATATTGTTCCTTCCCATGTTTGTAAAAGG (SEQ ID NO: 1918) | 15 |
| 127 | sAD | TAAATGTATATTGTCTTCCTAAAACAAATCGAACGTTAGTTCTCAATTCTTTGAGGAATT (SEQ ID NO: 1920) | 6 |
| 128 | mAD | TAAATGTATATTGTCTTCCTAAAACAAATCGAACGTTAGTTCTCAATTCTTTGAGGAATT (SEQ ID NO: 1920) | 6 |
| 129 | mAD | GTACTTTCATCATTTAGTTCTAAGCATTTCGATTCATGTCTTTCTTTCCTTTAGCTGACA (SEQ ID NO: 1922) | 13 |
| 130 | sAD | GTACTTTCATCATTTAGTTCTAAGCATTTCGATTCATGTCTTTCTTTCCTTTAGCTGACA (SEQ ID NO: 1922) | 13 |
| 131 | sAD | TAAAATAGGTCTATAAATTATACTTCAGTCGAATTTAATCTGCGTCTGATATGCTGGCAG (SEQ ID NO: 1924) | 11 |
| 132 | mAD | TAAAATAGGTCTATAAATTATACTTCAGTCGAATTTAATCTGCGTCTGATATGCTGGCAG (SEQ ID NO: 1924) | 11 |
| 133 | sAD | TTTTAAAGGATATACACATCTATCACTATCGAAAAGGCCAAGCTACTTCTAGAACAGTAT (SEQ ID NO: 1926) | 14 |
| 134 | mAD | TTTTAAAGGATATACACATCTATCACTATCGAAAAGGCCAAGCTACTTCTAGAACAGTAT (SEQ ID NO: 1926) | 14 |
| 135 | sAD | ATGTATTTTTCACAATATGAATTAAAAGTCGAACATTTGTCCAAGTTTTCTTTTGGAAAA (SEQ ID NO: 1928) | 10 |
| 136 | mAD | ATGTATTTTTCACAATATGAATTAAAAGTCGAACATTTGTCCAAGTTTTCTTTTGGAAAA | 10 |

TABLE 3.b5-continued

| | Loop Detected | Probe sequence 60 mer | Probe Location Chr |
|---|---|---|---|
| | | (SEQ ID NO: 1928) | |
| 137 | sAD | TTAAAGCAAGTTATGTAGGTAATTAATTTCGAAATAGTGGGAATATTGTAATAGTCTTTA (SEQ ID NO: 1930) | 13 |
| 138 | mAD | TTAAAGCAAGTTATGTAGGTAATTAATTTCGAAATAGTGGGAATATTGTAATAGTCTTTA (SEQ ID NO: 1930) | 13 |
| 139 | sAD | GGTCATTATTAAGTAAAATAAGGGTTACTCGAAGCCTAGCTACAATCCTTCAAGAATCCT (SEQ ID NO: 1932) | 13 |
| 140 | mAD | GGTCATTATTAAGTAAAATAAGGGTTACTCGAAGCCTAGCTACAATCCTTCAAGAATCCT (SEQ ID NO: 1932) | 13 |
| 141 | sAD | AAAGATCGTGTGGAAGAAATTTCTCTGTTCGATATTGTTCCTTCCCATGTTTGTAAAAGG (SEQ ID NO: 1934) | 15 |
| 142 | mAD | AAAGATCGTGTGGAAGAAATTTCTCTGTTCGATATTGTTCCTTCCCATGTTTGTAAAAGG (SEQ ID NO: 1934) | 15 |
| 143 | mAD | ACTTAGTAGGATTTTTTTATTAAAATTTTCGAGGAACCACAGTGATGCTGTATTTTGTAA (SEQ ID NO: 1936) | 2 |
| 144 | sAD | ACTTAGTAGGATTTTTTTATTAAAATTTTCGAGGAACCACAGTGATGCTGTATTTTGTAA (SEQ ID NO: 1936) | 2 |
| 145 | mAD | CTTTTGACATTTCTTTTGTTGTTATTTTTCGATAAAGAATATGAACGCTAGCTCTTATGT (SEQ ID NO: 1938) | 2 |
| 146 | sAD | CTTTTGACATTTCTTTTGTTGTTATTTTTCGATAAAGAATATGAACGCTAGCTCTTATGT (SEQ ID NO: 1938) | 2 |
| 147 | sAD | CTTAAAAAAAAAAAAAATCTGTGAACTTTCGAAAGCATAGGAGCAACTAGGAGATTTATG (SEQ ID NO: 1940) | 6 |
| 148 | mAD | CTTAAAAAAAAAAAAAATCTGTGAACTTTCGAAAGCATAGGAGCAACTAGGAGATTTATG (SEQ ID NO: 1940) | 6 |
| 149 | sAD | ACTGGAGTTTTTCAAAGATTTTTTTGTATCGACTAGGGAGAGGCTTAGATACTTTAGTGT (SEQ ID NO: 1942) | 7 |
| 150 | mAD | ACTGGAGTTTTTCAAAGATTTTTTTGTATCGACTAGGGAGAGGCTTAGATACTTTAGTGT (SEQ ID NO: 1942) | 7 |
| 151 | mAD | GATGAGTAACATAGTAGAAAAAAATACTTCGATGTCACCTTTTTCTTTGCTCTTTGGTAG (SEQ ID NO: 1944) | 20 |
| 152 | sAD | GATGAGTAACATAGTAGAAAAAAATACTTCGATGTCACCTTTTTCTTTGCTCTTTGGTAG (SEQ ID NO: 1944) | 20 |
| 153 | mAD | AATATAGGAATATTAGTAAAATGGTGTATCGACCCAGCTCCACGTGGAGCTGGCTCCTCA (SEQ ID NO: 1946) | 5 |
| 154 | sAD | AATATAGGAATATTAGTAAAATGGTGTATCGACCCAGCTCCACGTGGAGCTGGCTCCTCA (SEQ ID NO: 1946) | 5 |
| 155 | sAD | ATAAAGAGCTCGGAAGTGAGCTCTTTAGTCGACTCTGCAATTTTTCGCATCAAAGTTCAC (SEQ ID NO: 1948) | 7 |
| 156 | mAD | ATAAAGAGCTCGGAAGTGAGCTCTTTAGTCGACTCTGCAATTTTTCGCATCAAAGTTCAC (SEQ ID NO: 1948) | 7 |
| 157 | sAD | GTCACAGAGATCTAATCCTATGTTTTCTTCGACACAACGTGTTAGATTCTACCAAGAACT (SEQ ID NO: 1950) | 4 |
| 158 | mAD | GTCACAGAGATCTAATCCTATGTTTTCTTCGACACAACGTGTTAGATTCTACCAAGAACT (SEQ ID NO: 1950) | 4 |
| 159 | sAD | GTTACTTTACAGTAATATAATTTGTAACTCGAGTCACTCCTTTTTTTTAATTTTAAGTAT (SEQ ID NO: 1952) | 6 |
| 160 | mAD | GTTACTTTACAGTAATATAATTTGTAACTCGAGTCACTCCTTTTTTTTAATTTTAAGTAT (SEQ ID NO: 1952) | 6 |
| 161 | mAD | TTGTGCTTTTATTCCAATGTTTAATTTATCGATAGCCCAGGAAAAGAGCAAAATTCAAAG (SEQ ID NO: 1954) | 10 |

TABLE 3.b5-continued

| | Loop Detected | Probe sequence 60 mer | Probe Location Chr |
|---|---|---|---|
| 162 | sAD | TTGTGCTTTTATTCCAATGTTTAATTTATCGATAGCCCAGGAAAAGAGCAAAATTCAAAG (SEQ ID NO: 1954) | 10 |
| 163 | sAD | GTACTATAGTGACAAAGTAGTTGTCACATCGAAGGAAAAAATTGATATACAGAATGAAGC (SEQ ID NO: 1956) | 2 |
| 164 | mAD | GTACTATAGTGACAAAGTAGTTGTCACATCGAAGGAAAAAATTGATATACAGAATGAAGC (SEQ ID NO: 1956) | 2 |
| 165 | sAD | ACAAGATCCTTGAGAATCATTTCTGCCTTCGAATCTTGATAAGAGAAATGCCAAGAGGTT (SEQ ID NO: 1958) | 1 |
| 166 | mAD | ACAAGATCCTTGAGAATCATTTCTGCCTTCGAATCTTGATAAGAGAAATGCCAAGAGGTT (SEQ ID NO: 1958) | 1 |
| 167 | sAD | TGTCAATTTTCAATATAATTCATACAGTTCGAGTAAAGGTGGACTTGACTTGAGAAGATA (SEQ ID NO: 1960) | 1 |
| 168 | mAD | TGTCAATTTTCAATATAATTCATACAGTTCGAGTAAAGGTGGACTTGACTTGAGAAGATA (SEQ ID NO: 1960) | 1 |
| 169 | sAD | TTCTTTTATTTCATATAAAGATGAAGTCTCGAGACCTCATGACAATCTCCAAAAGTAGGT (SEQ ID NO: 1962) | 10 |
| 170 | mAD | TTCTTTTATTTCATATAAAGATGAAGTCTCGAGACCTCATGACAATCTCCAAAAGTAGGT (SEQ ID NO: 1962) | 10 |
| 171 | sAD | TTCTTGAACTAAAGATCTTAAAAGGCCTTCGAATTTCCTAACTTCCAGGATGATATTCTT (SEQ ID NO: 1964) | 12 |
| 172 | mAD | TTCTTGAACTAAAGATCTTAAAAGGCCTTCGAATTTCCTAACTTCCAGGATGATATTCTT (SEQ ID NO: 1964) | 12 |
| 173 | mAD | AAATATTCAAGATTCAGATGAATTCAAATCGATGCTACATATGATTGCTTGATTTCTAAA (SEQ ID NO: 1966) | 13 |
| 174 | sAD | AAATATTCAAGATTCAGATGAATTCAAATCGATGCTACATATGATTGCTTGATTTCTAAA (SEQ ID NO: 1966) | 13 |
| 175 | mAD | TTCCTTTATATTTTGTTTGTCTTCTTTATCGAGTTCTTCTCTTAGAAATATTTCCTGACA (SEQ ID NO: 1968) | 15 |
| 176 | sAD | TTCCTTTATATTTTGTTTGTCTTCTTTATCGAGTTCTTCTCTTAGAAATATTTCCTGACA (SEQ ID NO: 1968) | 15 |
| 177 | sAD | TTAAATATATCATGATTTTAAATGTTCTTCGATGAGTGAATGAGGGAACAAGTAATGTCT (SEQ ID NO: 1970) | 19 |
| 178 | mAD | TTAAATATATCATGATTTTAAATGTTCTTCGATGAGTGAATGAGGGAACAAGTAATGTCT (SEQ ID NO: 1970) | 19 |
| 179 | mAD | TATTCAGTATCTACTAGGGAGGATTTAATCGAAACCCATAAAATGTACAACACAACAGGA (SEQ ID NO: 1972) | 3 |
| 180 | sAD | TATTCAGTATCTACTAGGGAGGATTTAATCGAAACCCATAAAATGTACAACACAACAGGA (SEQ ID NO: 1972) | 3 |
| 181 | mAD | TTTAGTATTAGAAATGTTTTGGTCTTTATCGAGATGAAGTGTGTGAAAGAAAAGTTACTG (SEQ ID NO: 1974) | 3 |
| 182 | sAD | TTTAGTATTAGAAATGTTTTGGTCTTTATCGAGATGAAGTGTGTGAAAGAAAAGTTACTG (SEQ ID NO: 1974) | 3 |
| 183 | mAD | ATATATGACCTAACCTATTAAAAAGAGATCGAGTAGGAGGCTTAACATTGTTTTTCTTAG (SEQ ID NO: 1976) | 4 |
| 184 | sAD | ATATATGACCTAACCTATTAAAAAGAGATCGAGTAGGAGGCTTAACATTGTTTTTCTTAG (SEQ ID NO: 1976) | 4 |
| 185 | sAD | CATGGCTTCTTTCCTAGAAAAATTGTCTTCGAATGAGACATAAGTAGTGATTTGAAGAAT (SEQ ID NO: 1978) | 6 |
| 186 | mAD | CATGGCTTCTTTCCTAGAAAAATTGTCTTCGAATGAGACATAAGTAGTGATTTGAAGAAT (SEQ ID NO: 1978) | 6 |

TABLE 3.b5-continued

| | Loop Detected | Probe sequence 60 mer | Probe Location Chr |
|---|---|---|---|
| 187 | sAD | TTAATAGCAAAAAGATCAATATCTACTTTCGACTGGGAGAAAAGAATGAAAAATGTTAAA (SEQ ID NO: 1980) | 8 |
| 188 | mAD | TTAATAGCAAAAAGATCAATATCTACTTTCGACTGGGAGAAAAGAATGAAAAATGTTAAA (SEQ ID NO: 1980) | 8 |
| 189 | sAD | CTAAAATGAATCCTAAAGGTCTTTTTGTTCGATTTTGAAAAGCACATGTTTCCTTCCTTT (SEQ ID NO: 1084) | 8 |
| 190 | mAD | CTAAAATGAATCCTAAAGGTCTTTTTGTTCGATTTTGAAAAGCACATGTTTCCTTCCTTT (SEQ ID NO: 1084) | 8 |
| 191 | sAD | TAAATGTGAGCTACAGTTTATCTACAAATCGATTTTTTCATTTTAGGTTGTGAAGACTGT (SEQ ID NO: 1984) | X |
| 192 | mAD | TAAATGTGAGCTACAGTTTATCTACAAATCGATTTTTTCATTTTAGGTTGTGAAGACTGT (SEQ ID NO: 1984) | X |
| 193 | mAD | TATAAATACCAGAGAAGAAGCCATATTTTCGAAAATATTTGACATAGTTGATCACTTCCT (SEQ ID NO: 1986) | 2 |
| 194 | sAD | TATAAATACCAGAGAAGAAGCCATATTTTCGAAAATATTTGACATAGTTGATCACTTCCT (SEQ ID NO: 1986) | 2 |
| 195 | mAD | TGTTGTGAACTTTTGAAACAAATTTGTTTCGAGATCTATAATAAAGCAAAGGAGAGTCTC (SEQ ID NO: 1988) | 6 |
| 196 | sAD | TGTTGTGAACTTTTGAAACAAATTTGTTTCGAGATCTATAATAAAGCAAAGGAGAGTCTC (SEQ ID NO: 1988) | 6 |
| 197 | sAD | TATAAATACCAGAGAAGAAGCCATATTTTCGAATCAGTAATCTTTCTTCTGGGAATCTAG (SEQ ID NO: 1990) | 2 |
| 198 | mAD | TATAAATACCAGAGAAGAAGCCATATTTTCGAATCAGTAATCTTTCTTCTGGGAATCTAG (SEQ ID NO: 1990) | 2 |
| 199 | sAD | CTGTTTCTTACTTCTGAAACTTACAATTTCGAATTATGTTTCTGTCTCTTCCTTTCCTGT (SEQ ID NO: 1992) | 8 |
| 200 | mAD | CTGTTTCTTACTTCTGAAACTTACAATTTCGAATTATGTTTCTGTCTCTTCCTTTCCTGT (SEQ ID NO: 1992) | 8 |
| 201 | sAD | TTAGAGAATGAGAAAGACATGTCCTTAATCGATATAACTCTCAAATTTTGCCTAAATGAG (SEQ ID NO: 1994) | 11 |
| 202 | mAD | TTAGAGAATGAGAAAGACATGTCCTTAATCGATATAACTCTCAAATTTTGCCTAAATGAG (SEQ ID NO: 1994) | 11 |
| 203 | sAD | GTTAACATAGCTAAGTACCTCCGAAATATCGATGTCATATTTTATGTGTAATATATATGT (SEQ ID NO: 1996) | 13 |
| 204 | mAD | GTTAACATAGCTAAGTACCTCCGAAATATCGATGTCATATTTTATGTGTAATATATATGT (SEQ ID NO: 1996) | 13 |
| 205 | sAD | TTCTCTTCTTTATTGCATTAATCTGGTTTCGATTTCACCAAGTTTGCAAAGATTCTGTG (SEQ ID NO: 1998) | 2 |
| 206 | mAD | TTCTCTTCTTTATTGCATTAATCTGGTTTCGATTTCACCAAGTTTGCAAAGATTCTGTG (SEQ ID NO: 1998) | 2 |
| 207 | mAD | ATTTACTCAAACTTCCTAAGTGCTTATTTCGAAAGTTGATGCCAAATTGGGAAGTAAGAC (SEQ ID NO: 2000) | 3 |
| 208 | sAD | ATTTACTCAAACTTCCTAAGTGCTTATTTCGAAAGTTGATGCCAAATTGGGAAGTAAGAC (SEQ ID NO: 2000) | 3 |
| 209 | mAD | TCTAACCATTATGAGTAGATATTAATCTTCGAGTGGTGATATATTTGACCAGGGAAATAA (SEQ ID NO: 2002) | 14 |
| 210 | sAD | TCTAACCATTATGAGTAGATATTAATCTTCGAGTGGTGATATATTTGACCAGGGAAATAA (SEQ ID NO: 2002) | 14 |
| 211 | sAD | TACATTTTTAGCTCATCATAAAAGATATTCGACTCTGGGTTTGACACACATTAGTTTCTT (SEQ ID NO: 2004) | 1 |
| 212 | mAD | TACATTTTTAGCTCATCATAAAAGATATTCGACTCTGGGTTTGACACACATTAGTTTCTT | 1 |

TABLE 3.b5-continued

| | Loop Detected | Probe sequence 60 mer | Probe Location Chr |
|---|---|---|---|
| | | (SEQ ID NO: 2004) | |
| 213 | mAD | ATGTATTTTTCACAATATGAATTAAAAGTCGACTGATACAACTGACAGGTAGATAGCATT (SEQ ID NO: 2006) | 10 |
| 214 | sAD | ATGTATTTTTCACAATATGAATTAAAAGTCGACTGATACAACTGACAGGTAGATAGCATT (SEQ ID NO: 2006) | 10 |
| 215 | sAD | CAGTTTTTTAACACCACTGTTGGTGATTTCGATATTACCTTTTTTCTGGAACCATCTTTC (SEQ ID NO: 2008) | 10 |
| 216 | mAD | CAGTTTTTTAACACCACTGTTGGTGATTTCGATATTACCTTTTTTCTGGAACCATCTTTC (SEQ ID NO: 2008) | 10 |
| 217 | mAD | ATGAGACCAAATTACCCTTTGAATTCTCTCGAAGCTTGTTTTCTTTCACACTCCTAGTGC (SEQ ID NO: 2010) | 10 |
| 218 | sAD | ATGAGACCAAATTACCCTTTGAATTCTCTCGAAGCTTGTTTTCTTTCACACTCCTAGTGC (SEQ ID NO: 2010) | 10 |
| 219 | mAD | ACAGATTAAAACTATGAGGATATACCATTCGACATCTTTCATATCTGATTCTTTTTCCTT (SEQ ID NO: 2012) | 12 |
| 220 | sAD | ACAGATTAAAACTATGAGGATATACCATTCGACATCTTTCATATCTGATTCTTTTTCCTT (SEQ ID NO: 2012) | 12 |

TABLE 3.b6

| | Probe Location | | | | 4 kb Sequence Location | | | | |
|---|---|---|---|---|---|---|---|---|---|
| | Start1 | End1 | Start2 | End2 | Chr | Start1 | End1 | Start2 | End2 |
| 111 | 99005576 | 99005607 | 99054128 | 99054159 | 12 | 99001606 | 99005607 | 99054128 | 99058129 |
| 112 | 99005576 | 99005607 | 99054128 | 99054159 | 12 | 99001606 | 99005607 | 99054128 | 99058129 |
| 113 | 157433299 | 157433330 | 157514884 | 157514915 | 6 | 157429329 | 157433330 | 157510914 | 157514915 |
| 114 | 157433299 | 157433330 | 157514884 | 157514915 | 6 | 157429329 | 157433330 | 157510914 | 157514915 |
| 115 | 147568821 | 147568852 | 147649122 | 147649153 | 7 | 147564851 | 147568852 | 147649122 | 147653123 |
| 116 | 147568821 | 147568852 | 147649122 | 147649153 | 7 | 147564851 | 147568852 | 147649122 | 147653123 |
| 117 | 34062321 | 34062352 | 34131004 | 34131035 | 21 | 34062321 | 34066322 | 34127034 | 34131035 |
| 118 | 34062321 | 34062352 | 34131004 | 34131035 | 21 | 34062321 | 34066322 | 34127034 | 34131035 |
| 119 | 121118423 | 121118454 | 121226096 | 121226127 | 10 | 121118423 | 121122424 | 121222126 | 121226127 |
| 120 | 121118423 | 121118454 | 121226096 | 121226127 | 10 | 121118423 | 121122424 | 121222126 | 121226127 |
| 121 | 42385888 | 42385919 | 42471538 | 42471569 | 5 | 42381918 | 42385919 | 42467568 | 42471569 |
| 122 | 42385888 | 42385919 | 42471538 | 42471569 | 5 | 42381918 | 42385919 | 42467568 | 42471569 |
| 123 | 159206195 | 159206226 | 159243092 | 159243123 | 5 | 159206195 | 159210196 | 159239122 | 159243123 |
| 124 | 159206195 | 159206226 | 159243092 | 159243123 | 5 | 159206195 | 159210196 | 159239122 | 159243123 |
| 125 | 96265261 | 96265292 | 96328347 | 96328378 | 15 | 96265261 | 96269262 | 96328347 | 96332348 |
| 126 | 96265261 | 96265292 | 96328347 | 96328378 | 15 | 96265261 | 96269262 | 96328347 | 96332348 |
| 127 | 158448894 | 158448925 | 158477705 | 158477736 | 6 | 158444924 | 158448925 | 158473735 | 158477736 |
| 128 | 158448894 | 158448925 | 158477705 | 158477736 | 6 | 158444924 | 158448925 | 158473735 | 158477736 |
| 129 | 99298431 | 99298462 | 99373432 | 99373463 | 13 | 99298431 | 99302432 | 99373432 | 99377433 |
| 130 | 99298431 | 99298462 | 99373432 | 99373463 | 13 | 99298431 | 99302432 | 99373432 | 99377433 |
| 131 | 120020754 | 120020785 | 120066945 | 120066976 | 11 | 120016784 | 120020785 | 120066945 | 120070946 |
| 132 | 120020754 | 120020785 | 120066945 | 120066976 | 11 | 120016784 | 120020785 | 120066945 | 120070946 |
| 133 | 74830356 | 74830387 | 74873740 | 74873771 | 14 | 74830356 | 74834357 | 74873740 | 74877741 |
| 134 | 74830356 | 74830387 | 74873740 | 74873771 | 14 | 74830356 | 74834357 | 74873740 | 74877741 |
| 135 | 121477867 | 121477898 | 121570719 | 121570750 | 10 | 121477867 | 121481868 | 121566749 | 121570750 |
| 136 | 121477867 | 121477898 | 121570719 | 121570750 | 10 | 121477867 | 121481868 | 121566749 | 121570750 |
| 137 | 23148292 | 23148323 | 23204130 | 23204161 | 13 | 23148292 | 23152293 | 23204130 | 23208131 |
| 138 | 23148292 | 23148323 | 23204130 | 23204161 | 13 | 23148292 | 23152293 | 23204130 | 23208131 |
| 139 | 45996676 | 45996707 | 46057524 | 46057555 | 13 | 45996676 | 46000677 | 46057524 | 46061525 |
| 140 | 45996676 | 45996707 | 46057524 | 46057555 | 13 | 45996676 | 46000677 | 46057524 | 46061525 |
| 141 | 96275929 | 96275960 | 96328347 | 96328378 | 15 | 96275929 | 96279930 | 96328347 | 96332348 |
| 142 | 96275929 | 96275960 | 96328347 | 96328378 | 15 | 96275929 | 96279930 | 96328347 | 96332348 |
| 143 | 65243941 | 65243972 | 65289753 | 65289784 | 2 | 65239971 | 65243972 | 65289753 | 65293754 |
| 144 | 65243941 | 65243972 | 65289753 | 65289784 | 2 | 65239971 | 65243972 | 65289753 | 65293754 |
| 145 | 79971437 | 79971468 | 80055013 | 80055044 | 2 | 79971437 | 79975438 | 80051043 | 80055044 |
| 146 | 79971437 | 79971468 | 80055013 | 80055044 | 2 | 79971437 | 79975438 | 80051043 | 80055044 |
| 147 | 23219349 | 23219380 | 23277123 | 23277154 | 6 | 23219349 | 23223350 | 23273153 | 23277154 |
| 148 | 23219349 | 23219380 | 23277123 | 23277154 | 6 | 23219349 | 23223350 | 23273153 | 23277154 |
| 149 | 155744301 | 155744332 | 155779388 | 155779419 | 7 | 155740331 | 155744332 | 155779388 | 155783389 |
| 150 | 155744301 | 155744332 | 155779388 | 155779419 | 7 | 155740331 | 155744332 | 155779388 | 155783389 |
| 151 | 8541347 | 8541378 | 8590421 | 8590452 | 20 | 8537377 | 8541378 | 8590421 | 8594422 |

TABLE 3.b6-continued

| | Probe Location | | | | 4 kb Sequence Location | | | |
|---|---|---|---|---|---|---|---|---|
| | Start1 | End1 | Start2 | End2 | Chr | Start1 | End1 | Start2 | End2 |
| 152 | 8541347 | 8541378 | 8590421 | 8590452 | 20 | 8537377 | 8541378 | 8590421 | 8594422 |
| 153 | 173916958 | 173916989 | 173969421 | 173969452 | 5 | 173916958 | 173920959 | 173969421 | 173973422 |
| 154 | 173916958 | 173916989 | 173969421 | 173969452 | 5 | 173916958 | 173920959 | 173969421 | 173973422 |
| 155 | 117292584 | 117292615 | 117366498 | 117366529 | 7 | 117292584 | 117296585 | 117362528 | 117366529 |
| 156 | 117292584 | 117292615 | 117366498 | 117366529 | 7 | 117292584 | 117296585 | 117362528 | 117366529 |
| 157 | 151328386 | 151328417 | 151358698 | 151358729 | 4 | 151328386 | 151332387 | 151358698 | 151362699 |
| 158 | 151328386 | 151328417 | 151358698 | 151358729 | 4 | 151328386 | 151332387 | 151358698 | 151362699 |
| 159 | 82026159 | 82026190 | 82077947 | 82077978 | 6 | 82026159 | 82030160 | 82077947 | 82081948 |
| 160 | 82026159 | 82026190 | 82077947 | 82077978 | 6 | 82026159 | 82030160 | 82077947 | 82081948 |
| 161 | 104234446 | 104234477 | 104264982 | 104265013 | 10 | 104234446 | 104238447 | 104264982 | 104268983 |
| 162 | 104234446 | 104234477 | 104264982 | 104265013 | 10 | 104234446 | 104238447 | 104264982 | 104268983 |
| 163 | 77504275 | 77504306 | 77514867 | 77514898 | 2 | 77500305 | 77504306 | 77514867 | 77518868 |
| 164 | 77504275 | 77504306 | 77514867 | 77514898 | 2 | 77500305 | 77504306 | 77514867 | 77518868 |
| 165 | 76032659 | 76032690 | 76079501 | 76079532 | 1 | 76032659 | 76036660 | 76075531 | 76079532 |
| 166 | 76032659 | 76032690 | 76079501 | 76079532 | 1 | 76032659 | 76036660 | 76075531 | 76079532 |
| 167 | 8424469 | 8424500 | 8478289 | 8478320 | 1 | 8420499 | 8424500 | 8478289 | 8482290 |
| 168 | 8424469 | 8424500 | 8478289 | 8478320 | 1 | 8420499 | 8424500 | 8478289 | 8482290 |
| 169 | 97762614 | 97762645 | 97793747 | 97793778 | 10 | 97762614 | 97766615 | 97789777 | 97793778 |
| 170 | 97762614 | 97762645 | 97793747 | 97793778 | 10 | 97762614 | 97766615 | 97789777 | 97793778 |
| 171 | 75072794 | 75072825 | 75143109 | 75143140 | 12 | 75068824 | 75072825 | 75139139 | 75143140 |
| 172 | 75072794 | 75072825 | 75143109 | 75143140 | 12 | 75068824 | 75072825 | 75139139 | 75143140 |
| 173 | 51302963 | 51302994 | 51323631 | 51323662 | 13 | 51302963 | 51306964 | 51323631 | 51327632 |
| 174 | 51302963 | 51302994 | 51323631 | 51323662 | 13 | 51302963 | 51306964 | 51323631 | 51327632 |
| 175 | 77328486 | 77328517 | 77382463 | 77382494 | 15 | 77328486 | 77332487 | 77382463 | 77386464 |
| 176 | 77328486 | 77328517 | 77382463 | 77382494 | 15 | 77328486 | 77332487 | 77382463 | 77386464 |
| 177 | 56925538 | 56925569 | 56987150 | 56987181 | 19 | 56921568 | 56925569 | 56987150 | 56991151 |
| 178 | 56925538 | 56925569 | 56987150 | 56987181 | 19 | 56921568 | 56925569 | 56987150 | 56991151 |
| 179 | 105438463 | 105438494 | 105507308 | 105507339 | 3 | 105434493 | 105438494 | 105503338 | 105507339 |
| 180 | 105438463 | 105438494 | 105507308 | 105507339 | 3 | 105434493 | 105438494 | 105503338 | 105507339 |
| 181 | 16444934 | 16444965 | 16479555 | 16479586 | 3 | 16440964 | 16444965 | 16475585 | 16479586 |
| 182 | 16444934 | 16444965 | 16479555 | 16479586 | 3 | 16440964 | 16444965 | 16475585 | 16479586 |
| 183 | 125340607 | 125340638 | 125392915 | 125392946 | 4 | 125340607 | 125344608 | 125392915 | 125396916 |
| 184 | 125340607 | 125340638 | 125392915 | 125392946 | 4 | 125340607 | 125344608 | 125392915 | 125396916 |
| 185 | 168789036 | 168789067 | 168918636 | 168918667 | 6 | 168789036 | 168793037 | 168918636 | 168922637 |
| 186 | 168789036 | 168789067 | 168918636 | 168918667 | 6 | 168789036 | 168793037 | 168918636 | 168922637 |
| 187 | 109580000 | 109580031 | 109640164 | 109640195 | 8 | 109580000 | 109584001 | 109636194 | 109640195 |
| 188 | 109580000 | 109580031 | 109640164 | 109640195 | 8 | 109580000 | 109584001 | 109636194 | 109640195 |
| 189 | 28475847 | 28475878 | 28536205 | 28536236 | 8 | 28471877 | 28475878 | 28536205 | 28540206 |
| 190 | 28475847 | 28475878 | 28536205 | 28536236 | 8 | 28471877 | 28475878 | 28536205 | 28540206 |
| 191 | 111110469 | 111110500 | 111175862 | 111175893 | X | 111106499 | 111110500 | 111171892 | 111175893 |
| 192 | 111110469 | 111110500 | 111175862 | 111175893 | X | 111106499 | 111110500 | 111171892 | 111175893 |
| 193 | 38114263 | 38114294 | 38179203 | 38179234 | 2 | 38110293 | 38114294 | 38179203 | 38183204 |
| 194 | 38114263 | 38114294 | 38179203 | 38179234 | 2 | 38110293 | 38114294 | 38179203 | 38183204 |
| 195 | 115984820 | 115984851 | 116077719 | 116077750 | 6 | 115980850 | 115984851 | 116073749 | 116077750 |
| 196 | 115984820 | 115984851 | 116077719 | 116077750 | 6 | 115980850 | 115984851 | 116073749 | 116077750 |
| 197 | 38114263 | 38114294 | 38180947 | 38180978 | 2 | 38110293 | 38114294 | 38176977 | 38180978 |
| 198 | 38114263 | 38114294 | 38180947 | 38180978 | 2 | 38110293 | 38114294 | 38176977 | 38180978 |
| 199 | 22651886 | 22651917 | 22674453 | 22674484 | 8 | 22647916 | 22651917 | 22670483 | 22674484 |
| 200 | 22651886 | 22651917 | 22674453 | 22674484 | 8 | 22647916 | 22651917 | 22670483 | 22674484 |
| 201 | 133325771 | 133325802 | 133378245 | 133378276 | 11 | 133321801 | 133325802 | 133378245 | 133382246 |
| 202 | 133325771 | 133325802 | 133378245 | 133378276 | 11 | 133321801 | 133325802 | 133378245 | 133382246 |
| 203 | 32247490 | 32247521 | 32296396 | 32296427 | 13 | 32247490 | 32251491 | 32296396 | 32300397 |
| 204 | 32247490 | 32247521 | 32296396 | 32296427 | 13 | 32247490 | 32251491 | 32296396 | 32300397 |
| 205 | 102956535 | 102956566 | 102983000 | 102983031 | 2 | 102952565 | 102956566 | 102983000 | 102987001 |
| 206 | 102956535 | 102956566 | 102983000 | 102983031 | 2 | 102952565 | 102956566 | 102983000 | 102987001 |
| 207 | 65827279 | 65827310 | 65903659 | 65903690 | 3 | 65827279 | 65831280 | 65899689 | 65903690 |
| 208 | 65827279 | 65827310 | 65903659 | 65903690 | 3 | 65827279 | 65831280 | 65899689 | 65903690 |
| 209 | 68260022 | 68260053 | 68327682 | 68327713 | 14 | 68260022 | 68264023 | 68323712 | 68327713 |
| 210 | 68260022 | 68260053 | 68327682 | 68327713 | 14 | 68260022 | 68264023 | 68323712 | 68327713 |
| 211 | 13952953 | 13952984 | 14008502 | 14008533 | 1 | 13948983 | 13952984 | 14004532 | 14008533 |
| 212 | 13952953 | 13952984 | 14008502 | 14008533 | 1 | 13948983 | 13952984 | 14004532 | 14008533 |
| 213 | 121570719 | 121570750 | 121690817 | 121690848 | 10 | 121566749 | 121570750 | 121690817 | 121694818 |
| 214 | 121570719 | 121570750 | 121690817 | 121690848 | 10 | 121566749 | 121570750 | 121690817 | 121694818 |
| 215 | 25034559 | 25034590 | 25084183 | 25084214 | 10 | 25034559 | 25038560 | 25080213 | 25084214 |
| 216 | 25034559 | 25034590 | 25084183 | 25084214 | 10 | 25034559 | 25038560 | 25080213 | 25084214 |
| 217 | 76412044 | 76412075 | 76458091 | 76458122 | 10 | 76408074 | 76412075 | 76458091 | 76462092 |
| 218 | 76412044 | 76412075 | 76458091 | 76458122 | 10 | 76408074 | 76412075 | 76458091 | 76462092 |
| 219 | 10096371 | 10096402 | 10158041 | 10158072 | 12 | 10096371 | 10100372 | 10154071 | 10158072 |
| 220 | 10096371 | 10096402 | 10158041 | 10158072 | 12 | 10096371 | 10100372 | 10154071 | 10158072 |

TABLE 3.b7

| | Probe | PCR-Primer1_ID | PCR_Primer1 |
|---|---|---|---|
| 111 | ORF12_12_99003375_99005607_99054128_99056579_FR | OBD159_1581 | TCAAAACCTGACATAAATGCCTCA (SEQ ID NO: 2014) |
| 112 | ORF12_12_99003375_99005607_99054128_99056579_FR | OBD159_1581 | TCAAAACCTGACATAAATGCCTCA (SEQ ID NO: 2014) |
| 113 | ORF12_6_157429181_157433330_157512149_157514915_FF | OBD159_1585 | AGCGGTGTGCCTGTGTCTAATGAACG (SEQ ID NO: 2016) |
| 114 | ORF12_6_157429181_157433330_157512149_157514915_FF | OBD159_1585 | AGCGGTGTGCCTGTGTCTAATGAACG (SEQ ID NO: 2016) |
| 115 | ORF12_7_147567494_147568852_147649122_147653562_FR | OBD159_1589 | CAGGTGTTACCAGCATCCTCTCCCTA (SEQ ID NO: 2018) |
| 116 | ORF12_7_147567494_147568852_147649122_147653562_FR | OBD159_1589 | CAGGTGTTACCAGCATCCTCTCCCTA (SEQ ID NO: 2018) |
| 117 | ORF120_21_34062321_34063413_34127427_34131035_RF | OBD159_1593 | CACTGCTCGGCTTTGTGTTCAAGGCA (SEQ ID NO: 2020) |
| 118 | ORF120_21_34062321_34063413_34127427_34131035_RF | OBD159_1593 | CACTGCTCGGCTTTGTGTTCAAGGCA (SEQ ID NO: 2020) |
| 119 | ORF121_10_121118423_121121606_121215466_121226127_RF | OBD159_1597 | TGTTATGTTCATTCTCTGTGCCAGGC (SEQ ID NO: 2022) |
| 120 | ORF121_10_121118423_121121606_121215466_121226127_RF | OBD159_1597 | TGTTATGTTCATTCTCTGTGCCAGGC (SEQ ID NO: 2022) |
| 121 | ORF122_5_42377041_42385919_42468953_42471569_FF | OBD159_1601 | GGCAAAACAACTTCCCACTGACCTGT (SEQ ID NO: 2024) |
| 122 | ORF122_5_42377041_42385919_42468953_42471569_FF | OBD159_1601 | GGCAAAACAACTTCCCACTGACCTGT (SEQ ID NO: 2024) |
| 123 | ORF123_5_159206195_159208288_159235024_159243123_RF | OBD159_1605 | GCTGATACCTGAAGCGTGAGAAACAG (SEQ ID NO: 2026) |
| 124 | ORF123_5_159206195_159208288_159235024_159243123_RF | OBD159_1605 | GCTGATACCTGAAGCGTGAGAAACAG (SEQ ID NO: 2026) |
| 125 | ORF125_15_96265261_96271086_96328347_96331473_RR | OBD159_1609 | CCCTTCCCACTGGTTCTAATGACATC (SEQ ID NO: 2028) |
| 126 | ORF125_15_96265261_96271086_96328347_96331473_RR | OBD159_1609 | CCCTTCCCACTGGTTCTAATGACATC (SEQ ID NO: 2028) |
| 127 | ORF125_6_158443203_158448925_158476552_158477736_FF | OBD159_1613 | ATTTTGTGTCACTGTGCTGTTGTT (SEQ ID NO: 2030) |
| 128 | ORF125_6_158443203_158448925_158476552_158477736_FF | OBD159_1613 | ATTTTGTGTCACTGTGCTGTTGTT (SEQ ID NO: 2030) |
| 129 | ORF126_13_99298431_99304510_99373432_99375888_RR | OBD159_1617 | GCATCCCACAGTTTTCACAGGTA (SEQ ID NO: 2032) |
| 130 | ORF126_13_99298431_99304510_99373432_99375888_RR | OBD159_1617 | GCATCCCACAGTTTTCACAGGTA (SEQ ID NO: 2032) |
| 131 | ORF127_11_120012095_120020785_120066945_120072959_FR | OBD159_1621 | GTGGTGGTGGTTACATAAGGGAAAAC (SEQ ID NO: 2034) |
| 132 | ORF127_11_120012095_120020785_120066945_120072959_FR | OBD159_1621 | GTGGTGGTGGTTACATAAGGGAAAAC (SEQ ID NO: 2034) |
| 133 | ORF128_14_74830356_74835394_74873740_74878249_RR | OBD159_1625 | CAAACAATGGGACACCAAGTAGCCCT (SEQ ID NO: 2036) |
| 134 | ORF128_14_74830356_74835394_74873740_74878249_RR | OBD159_1625 | CAAACAATGGGACACCAAGTAGCCCT (SEQ ID NO: 2036) |
| 135 | ORF13_10_121477867_121479994_121564423_121570750_RF | OBD159_1629 | GGAGAAGGTTCCAGAAGCCGCCT (SEQ ID NO: 1742) |
| 136 | ORF13_10_121477867_121479994_121564423_121570750_RF | OBD159_1629 | GGAGAAGGTTCCAGAAGCCGCCT (SEQ ID NO: 1742) |

TABLE 3.b7-continued

| Probe | PCR-Primer1_ID | PCR_Primer1 |
|---|---|---|
| 137 ORF13_13_23148292_23151659_23204130_23213800_RR | OBD159_1633 | CAAAGTGCTGGGATTACAGGCAT (SEQ ID NO: 2040) |
| 138 ORF13_13_23148292_23151659_23204130_23213800_RR | OBD159_1633 | CAAAGTGCTGGGATTACAGGCAT (SEQ ID NO: 2040) |
| 139 ORF13_13_45996676_46000524_46057524_46060260_RR | OBD159_1637 | ATTGCCAGCATCACTCTTCTTTGC (SEQ ID NO: 2042) |
| 140 ORF13_13_45996676_46000524_46057524_46060260_RR | OBD159_1637 | ATTGCCAGCATCACTCTTCTTTGC (SEQ ID NO: 2042) |
| 141 ORF13_15_96275929_96277834_96328347_96331473_RR | OBD159_1641 | TAACTGGATTTTCTCTGGAATGAAGC (SEQ ID NO: 2044) |
| 142 ORF13_15_96275929_96277834_96328347_96331473_RR | OBD159_1641 | TAACTGGATTTTCTCTGGAATGAAGC (SEQ ID NO: 2044) |
| 143 ORF13_2_65241569_65243972_65289753_65296291_FR | OBD159_1645 | GGTTCTGAGTGATGAAGGCAAGT (SEQ ID NO: 2046) |
| 144 ORF13_2_65241569_65243972_65289753_65296291_FR | OBD159_1645 | GGTTCTGAGTGATGAAGGCAAGT (SEQ ID NO: 2046) |
| 145 ORF13_2_79971437_79976448_80050108_80055044_RF | OBD159_1649 | GGGTGAGTGGGAAGAATGGTGCTAT T (SEQ ID NO: 2048) |
| 146 ORF13_2_79971437_79976448_80050108_80055044_RF | OBD159_1649 | GGGTGAGTGGGAAGAATGGTGCTAT T (SEQ ID NO: 2048) |
| 147 ORF13_6_23219349_23223439_23271280_23277154_RF | OBD159_1653 | AATCACTTCAACCCAGGAGGTGGA (SEQ ID NO: 2050) |
| 148 ORF13_6_23219349_23223439_23271280_23277154_RF | OBD159_1653 | AATCACTTCAACCCAGGAGGTGGA (SEQ ID NO: 2050) |
| 149 ORF13_7_155741321_155744332_155779388_155780808_FR | OBD159_1657 | TATTTTACACGGAGTCTGTGGATA (SEQ ID NO: 2052) |
| 150 ORF13_7_155741321_155744332_155779388_155780808_FR | OBD159_1657 | TATTTTACACGGAGTCTGTGGATA (SEQ ID NO: 2052) |
| 151 ORF131_20_8536736_8541378_8590421_8594259_FR | OBD159_1661 | GCTGGTGTGCCACTAATGCTCTCCAA (SEQ ID NO: 2054) |
| 152 ORF131_20_8536736_8541378_8590421_8594259_FR | OBD159_1661 | GCTGGTGTGCCACTAATGCTCTCCAA (SEQ ID NO: 2054) |
| 153 ORF132_5_173916958_173918697_173969421_173970862_RR | OBD159_1665 | CTCTCCCCACCATTCCTACCTGA (SEQ ID NO: 2056) |
| 154 ORF132_5_173916958_173918697_173969421_173970862_RR | OBD159_1665 | CTCTCCCCACCATTCCTACCTGA (SEQ ID NO: 2056) |
| 155 ORF132_7_117292584_117297912_117353457_117366529_RF | OBD159_1669 | AGCCTGGGCAATGGAGTGAGACT (SEQ ID NO: 2058) |
| 156 ORF132_7_117292584_117297912_117353457_117366529_RF | OBD159_1669 | AGCCTGGGCAATGGAGTGAGACT (SEQ ID NO: 2058) |
| 157 ORF133_4_151328386_151338975_151358698_151359731_RR | OBD159_1673 | GTTCTCCCCTTCTGTCTTTTCACTTT (SEQ ID NO: 2060) |
| 158 ORF133_4_151328386_151338975_151358698_151359731_RR | OBD159_1673 | GTTCTCCCCTTCTGTCTTTTCACTTT (SEQ ID NO: 2060) |
| 159 ORF134_6_82026159_82034690_82077947_82085585_RR | OBD159_1677 | GATAACATTCACATTTTGACCAGC (SEQ ID NO: 2062) |
| 160 ORF134_6_82026159_82034690_82077947_82085585_RR | OBD159_1677 | GATAACATTCACATTTTGACCAGC (SEQ ID NO: 2062) |
| 161 ORF138_10_104234446_104238473_104264982_104269909_RR | OBD159_1681 | GCCAAATTTTACCTTTACATT (SEQ ID NO: 2064) |
| 162 ORF138_10_104234446_104238473_104264982_104269909_RR | OBD159_1681 | GCCAAATTTTACCTTTACATT (SEQ ID |

TABLE 3.b7-continued

| Probe | PCR-Primer1_ID | PCR_Primer1 |
|---|---|---|
| | | NO: 2064) |
| 163 ORF138_2_77502067_77504306_77514867_77519288_FR | OBD159_1685 | GCTAAATCCAGACTGCCACCATT (SEQ ID NO: 2066) |
| 164 ORF_138_2_77502067_77504306_77514867_77519288_FR | OBD159_1685 | GCTAAATCCAGACTGCCACCATT (SEQ ID NO: 2066) |
| 165 ORF14_1_76032659_76035831_76077590_76079532_RF | OBD159_1689 | ATGATTTCTACCCTTGGTCAGCAGGT (SEQ ID NO: 2068) |
| 166 ORF14_1_76032659_76035831_76077590_76079532_RF | OBD159_1689 | ATGATTTCTACCCTTGGTCAGCAGGT (SEQ ID NO: 2068) |
| 167 ORF14_1_8423193_8424500_8478289_8482650_FR | OBD159_1693 | TCCCTGTGTTTGAGACCCGCCAG (SEQ ID NO: 2070) |
| 168 ORF14_1_8423193_8424500_8478289_8482650_FR | OBD159_1693 | TCCCTGTGTTTGAGACCCGCCAG (SEQ ID NO: 2070) |
| 169 ORF14_10_97762614_97766905_97790822_97793778_RF | OBD159_1697 | GAACTGCTTCTTGCCTCCCTTCC (SEQ ID NO: 2072) |
| 170 ORF14_10_97762614_97766905_97790822_97793778_RF | OBD159_1697 | GAACTGCTTCTTGCCTCCCTTCC (SEQ ID NO: 2072) |
| 171 ORF14_12_75070822_75072825_75141366_75143140_FF | OBD159_1701 | CTGAGTGCCTGGGAATGACAGTC (SEQ ID NO: 2074) |
| 172 ORF14_12_75070822_75072825_75141366_75143140_FF | OBD159_1701 | CTGAGTGCCTGGGAATGACAGTC (SEQ ID NO: 2074) |
| 173 ORF14_13_51302963_51306635_51323631_51326485_RR | OBD159_1705 | CTCAAACACTGGCAACGCATTTTCCC (SEQ ID NO: 2076) |
| 174 ORF14_13_51302963_51306635_51323631_51326485_RR | OBD159_1705 | CTCAAACACTGGCAACGCATTTTCCC (SEQ ID NO: 2076) |
| 175 ORF14_15_77328486_77331349_77382463_77385598_RR | OBD159_1709 | CTCAGTTTCCTCACCAATCAGACTAC (SEQ ID NO: 2078) |
| 176 ORF14_15_77328486_77331349_77382463_77385598_RR | OBD159_1709 | CTCAGTTTCCTCACCAATCAGACTAC (SEQ ID NO: 2078) |
| 177 ORF14_19_56921649_56925569_56987150_56988841_FR | OBD159_1713 | CAGGCTGAGGCACTCTGGTCTAT (SEQ ID NO: 2080) |
| 178 ORF14_19_56921649_56925569_56987150_56988841_FR | OBD159_1713 | CAGGCTGAGGCACTCTGGTCTAT (SEQ ID NO: 2080) |
| 179 ORF14_3_105431137_105438494_105503436_105507339_FF | OBD159_1717 | CTTGGCATTTTACTTACTTATCTT (SEQ ID NO: 2082) |
| 180 ORF14_3_105431137_105438494_105503436_105507339_FF | OBD159_1717 | CTTGGCATTTTACTTACTTATCTT (SEQ ID NO: 2082) |
| 181 ORF14_3_16438382_16444965_16476728_16479586_FF | OBD159_1721 | CAACCACCATCACTCGCTGTTTTACC (SEQ ID NO: 2084) |
| 182 ORF14_3_16438382_16444965_16476728_16479586_FF | OBD159_1721 | CAACCACCATCACTCGCTGTTTTACC (SEQ ID NO: 2084) |
| 183 ORF14_4_125340607_125343598_125392915_125397466_RR | OBD159_1725 | GCCACCGCAACTGCTACACAACTACT (SEQ ID NO: 2086) |
| 184 ORF14_4_125340607_125343598_125392915_125397466_RR | OBD159_1725 | GCCACCGCAACTGCTACACAACTACT (SEQ ID NO: 2086) |
| 185 ORF14_6_168789036_168790083_168918636_168926703_RR | OBD159_1729 | CTGACACGCCTGCCTTCCTCTTT (SEQ ID NO: 2088) |
| 186 ORF14_6_168789036_168790083_168918636_168926703_RR | OBD159_1729 | CTGACACGCCTGCCTTCCTCTTT (SEQ ID NO: 2088) |
| 187 ORF14_8_109580000_109582610_109632260_109640195_RF | OBD159_1733 | AAGATGAAGAGAGATGAGGGAGAG GC (SEQ ID NO: 2090) |

TABLE 3.b7-continued

| Probe | PCR-Primer1_ID | PCR_Primer1 |
|---|---|---|
| 188 ORF14_8_109580000_109582610_109632260_109640195_RF | OBD159_1733 | AAGATGAAGAGAGATGAGGGAGAG GC (SEQ ID NO: 2090) |
| 189 ORF14_8_28471461_28475878_28536205_28541536_FR | OBD159_1737 | ATTGACTAACAACAACAAGAAAGC (SEQ ID NO: 1166) |
| 190 ORF14_8_28471461_28475878_28536205_28541536_FR | OBD159_1737 | ATTGACTAACAACAACAAGAAAGC (SEQ ID NO: 1166) |
| 191 ORF14_X_111096546_111110500_111165610_111175893_FF | OBD159_1741 | GAACTGAGCATAATCCTTCTTGTGAC (SEQ ID NO: 2094) |
| 192 ORF14_X_111096546_111110500_111165610_111175893_FF | OBD159_1741 | GAACTGAGCATAATCCTTCTTGTGAC (SEQ ID NO: 2094) |
| 193 ORF140_2_38110623_38114294_38179203_38180978_FR | OBD159_1745 | TGTGAAGGGCAGTGAATAAAGGATT A (SEQ ID NO: 2096) |
| 194 ORF140_2_38110623_38114294_38179203_38180978_FR | OBD159_1745 | TGTGAAGGGCAGTGAATAAAGGATT A (SEQ ID NO: 2096) |
| 195 ORF141_6_115981175_115984851_116074475_116077750_FF | OBD159_1749 | TGCCATTCACACAAAGTCTAAGGG (SEQ ID NO: 1780) |
| 196 ORF141_6_115981175_115984851_116074475_116077750_FF | OBD159_1749 | TGCCATTCACACAAAGTCTAAGGG (SEQ ID NO: 1780) |
| 197 ORF142_2_38110623_38114294_38179203_38180978_FF | OBD159_1753 | TGTGAAGGGCAGTGAATAAAGGATT A (SEQ ID NO: 2096) |
| 198 ORF_142_2_38110623_38114294_38179203_38180978_FF | OBD159_1753 | TGTGAAGGGCAGTGAATAAAGGATT A (SEQ ID NO: 2096) |
| 199 ORF142_8_22647922_22651917_22671292_22674484_FF | OBD159_1757 | GAAGCCACTCTGATTCCCATCCTTTG (SEQ ID NO: 2102) |
| 200 ORF142_8_22647922_22651917_22671292_22674484_FF | OBD159_1757 | GAAGCCACTCTGATTCCCATCCTTTG (SEQ ID NO: 2102) |
| 201 ORF144_11_133321952_133325802_133378245_133382756_FR | OBD159_1761 | GCAGGAGGGATGACTACTTGCCAA (SEQ ID NO: 2104) |
| 202 ORF144_11_133321952_133325802_133378245_133382756_FR | OBD159_1761 | GCAGGAGGGATGACTACTTGCCAA (SEQ ID NO: 2104) |
| 203 ORF144_13_32247490_32254361_32296396_32300347_RR | OBD159_1765 | GAAATAACTGTCAAATAAGTCTTC (SEQ ID NO: 2106) |
| 204 ORF_144_13_32247490_32254361_32296396_32300347_RR | OBD159_1765 | GAAATAACTGTCAAATAAGTCTTC (SEQ ID NO: 2106) |
| 205 ORF147_2_102946170_102956566_102983000_102995309_FR | OBD159_1769 | CTATTTGCTTCCATCTCTTCTTCAAG (SEQ ID NO: 2108) |
| 206 ORF147_2_102946170_102956566_102983000_102995309_FR | OBD159_1769 | CTATTTGCTTCCATCTCTTCTTCAAG (SEQ ID NO: 2108) |
| 207 ORF148_3_65827279_65831993_65898255_65903690_RF | OBD159_1773 | CCTAAGACAGAGGGAAAAGAAGGTA (SEQ ID NO: 2110) |
| 208 ORF148_3_65827279_65831993_65898255_65903690_RF | OBD159_1773 | CCTAAGACAGAGGGAAAAGAAGGTA (SEQ ID NO: 2110) |
| 209 ORF149_14_68260022_68266399_68325745_68327713_RF | OBD159_1777 | GCCAAAGACTCCTCTGGGAATCC (SEQ ID NO: 2112) |
| 210 ORF149_14_68260022_68266399_68325745_68327713_RF | OBD159_1777 | GCCAAAGACTCCTCTGGGAATCC (SEQ ID NO: 2112) |
| 211 ORF15_1_13945271_13952984_14001723_14008533_FF | OBD159_1781 | TTGTGCTGTGTGACCTTGGGATGTCC (SEQ ID NO: 2114) |
| 212 ORF15_1_13945271_13952984_14001723_14008533_FF | OBD159_1781 | TTGTGCTGTGTGACCTTGGGATGTCC (SEQ ID NO: 2114) |
| 213 ORF15_10_121564423_121570750_121690817_121692131_FR | OBD159_1785 | GAGGCTTCCACAGACAGAGAATA (SEQ ID NO: 2116) |

TABLE 3.b7-continued

| Probe | PCR-Primer1_ID | PCR_Primer1 |
|---|---|---|
| 214 ORF15_10_121564423_121570750_121690817_121692131_FR | OBD159_1785 | GAGGCTTCCACAGACAGAGAATA (SEQ ID NO: 2116) |
| 215 ORF15_10_25034559_25040591_25081322_25084214_RF | OBD159_1789 | CCTCCAAACAGTAGCATCACATCACC (SEQ ID NO: 2118) |
| 216 ORF15_10_25034559_25040591_25081322_25084214_RF | OBD159_1789 | CCTCCAAACAGTAGCATCACATCACC (SEQ ID NO: 2118) |
| 217 ORF15_10_76410191_76412075_76458091_76462498_FR | OBD159_1793 | GCCAGCCTCTGTTTGCCAATGGT (SEQ ID NO: 2120) |
| 218 ORF15_10_76410191_76412075_76458091_76462498_FR | OBD159_1793 | GCCAGCCTCTGTTTGCCAATGGT (SEQ ID NO: 2120) |
| 219 ORF15_12_10096371_10100557_10157054_10158072_RF | OBD159_1793 | AGCCTGAGCAACAAGAGCGAAACT (SEQ ID NO: 2122) |
| 220 ORF15_12_10096371_10100557_10157054_10158072_RF | OBD159_1797 | AGCCTGAGCAACAAGAGCGAAACT (SEQ ID NO: 2122) |

TABLE 3.b8

| | PCR-Primer2_ID | PCR_Primer2 | Marker | GLMNET |
|---|---|---|---|---|
| 111 | OBD159_1583 | AGCCTTGCTGTTTCCATCGTGAAT (SEQ ID NO: 2124) | OBD159_1581_1583 | 0.003298289 |
| 112 | OBD159_1583 | AGCCTTGCTGTTTCCATCGTGAAT (SEQ ID NO: 2124) | OBD159_1581_1583 | 0.003298289 |
| 113 | OBD159_1587 | AAACCAAGCCAACAAGGAACCCATTC (SEQ ID NO: 2126) | OBD159_1585_1587 | 0.001146182 |
| 114 | OBD159_1587 | AAACCAAGCCAACAAGGAACCCATTC (SEQ ID NO: 2126) | OBD159_1585_1587 | 0.001146182 |
| 115 | OBD159_1591 | TGACTGGATAACCTCACAGAGTTTCC (SEQ ID NO: 2128) | OBD159_1589_1591 | 0.001083337 |
| 116 | OBD159_1591 | TGACTGGATAACCTCACAGAGTTTCC (SEQ ID NO: 2128) | OBD159_1589_1591 | 0.001083337 |
| 117 | OBD159_1595 | GACAACTGAACCTTCCAGCATCTTGA (SEQ ID NO: 2130) | OBD159_1593_1595 | 0.000591066 |
| 118 | OBD159_1595 | GACAACTGAACCTTCCAGCATCTTGA (SEQ ID NO: 2130) | OBD159_1593_1595 | 0.000591066 |
| 119 | OBD159_1599 | GCCTCTCTCCAAACAATCAGGGCTCT (SEQ ID NO: 2132) | OBD159_1597_1599 | 0.000990022 |
| 120 | OBD159_1599 | GCCTCTCTCCAAACAATCAGGGCTCT (SEQ ID NO: 2132) | OBD159_1597_1599 | 0.000990022 |
| 121 | OBD159_1603 | CGTTGACCTTCCTACTTATCTAAACA (SEQ ID NO: 2134) | OBD159_1601_1603 | 0.001406379 |
| 122 | OBD159_1603 | CGTTGACCTTCCTACTTATCTAAACA (SEQ ID NO: 2134) | OBD159_1601_1603 | 0.001406379 |
| 123 | OBD159_1607 | GCTTGCCACTGACTTGCTAAAATAAC (SEQ ID NO: 2136) | OBD159_1605_1607 | 0.002050957 |
| 124 | OBD159_1607 | GCTTGCCACTGACTTGCTAAAATAAC (SEQ ID NO: 2136) | OBD159_1605_1607 | 0.002050957 |
| 125 | OBD159_1611 | CCTCCTGAATGAGACTTCCATAGCAG (SEQ ID NO: 2138) | OBD159_1609_1611 | 0.001445915 |
| 126 | OBD159_1611 | CCTCCTGAATGAGACTTCCATAGCAG (SEQ ID NO: 2138) | OBD159_1609_1611 | 0.001445915 |

TABLE 3.b8-continued

| | PCR-Primer2_ID | PCR_Primer2 | Marker | GLMNET |
|---|---|---|---|---|
| 127 | OBD159_1615 | AAAGGAAACGCTTCTACACTGCTA (SEQ ID NO: 2140) | OBD159_1613_1615 | 0.001481028 |
| 128 | OBD159_1615 | AAAGGAAACGCTTCTACACTGCTA (SEQ ID NO: 2140) | OBD159_1613_1615 | 0.001481028 |
| 129 | OBD159_1619 | GCCTTATCCATCTTAGTGTTTTCAGA (SEQ ID NO: 2142) | OBD159_1617_1619 | 0.000656997 |
| 130 | OBD159_1619 | GCCTTATCCATCTTAGTGTTTTCAGA (SEQ ID NO: 2142) | OBD159_1617_1619 | 0.000656997 |
| 131 | OBD159_1623 | GCGAGAGAGAAGAGAGGCATCCACAT (SEQ ID NO: 2144) | OBD159_1621_1623 | 0.000946101 |
| 132 | OBD159_1623 | GCGAGAGAGAAGAGAGGCATCCACAT (SEQ ID NO: 2144) | OBD159_1621_1623 | 0.000946101 |
| 133 | OBD159_1627 | GCTAAGCATTCCACCACTACAGCCTA (SEQ ID NO: 2146) | OBD159_1625_1627 | 0.000498191 |
| 134 | OBD159_1627 | GCTAAGCATTCCACCACTACAGCCTA (SEQ ID NO: 2146) | OBD159_1625_1627 | 0.000498191 |
| 135 | OBD159_1631 | CCCAGAGGAGCAAACAAAGAGCC (SEQ ID NO: 2148) | OBD159_1629_1631 | 0.000925033 |
| 136 | OBD159_1631 | CCCAGAGGAGCAAACAAAGAGCC (SEQ ID NO: 2148) | OBD159_1629_1631 | 0.000925033 |
| 137 | OBD159_1635 | CTGACTCAATCAACCACAAACTAAAG (SEQ ID NO: 2150) | OBD159_1633_1635 | 0.001554604 |
| 138 | OBD159_1635 | CTGACTCAATCAACCACAAACTAAAG (SEQ ID NO: 2150) | OBD159_1633_1635 | 0.001554604 |
| 139 | OBD159_1639 | CTGCCCTGACTTCCCTAACCCTC (SEQ ID NO: 2152) | OBD159_1637_1639 | 0.002206167 |
| 140 | OBD159_1639 | CTGCCCTGACTTCCCTAACCCTC (SEQ ID NO: 2152) | OBD159_1637_1639 | 0.002206167 |
| 141 | OBD159_1643 | TGAGACTTCCATAGCAGATTACCTTT (SEQ ID NO: 622) | OBD159_1641_1643 | 0.002552583 |
| 142 | OBD159_1643 | TGAGACTTCCATAGCAGATTACCTTT (SEQ ID NO: 622) | OBD159_1641_1643 | 0.002552583 |
| 143 | OBD159_1647 | CATTTCTCATCCCAGGCATTTCAGA (SEQ ID NO: 2156) | OBD159_1645_1647 | 0.001235373 |
| 144 | OBD159_1647 | CATTTCTCATCCCAGGCATTTCAGA (SEQ ID NO: 2156) | OBD159_1645_1647 | 0.001235373 |
| 145 | OBD159_1651 | ACCTGAGTTCAAATCCCTCTGCTCTC (SEQ ID NO: 2158) | OBD159_1649_1651 | 0.000308972 |
| 146 | OBD159_1651 | ACCTGAGTTCAAATCCCTCTGCTCTC (SEQ ID NO: 2158) | OBD159_1649_1651 | 0.000308972 |
| 147 | OBD159_1655 | CCTTATGCTGTTTTATGTTCCTAA (SEQ ID NO: 2160) | OBD159_1653_1655 | 0.001334444 |
| 148 | OBD159_1655 | CCTTATGCTGTTTTATGTTCCTAA (SEQ ID NO: 2160) | OBD159_1653_1655 | 0.001334444 |
| 149 | OBD159_1659 | ATAACACTCCATTCACAAACTTTA (SEQ ID NO: 2162) | OBD159_1657_1659 | 0.002743967 |
| 150 | OBD159_1659 | ATAACACTCCATTCACAAACTTTA (SEQ ID NO: 2162) | OBD159_1657_1659 | 0.002743967 |
| 151 | OBD159_1663 | GTCACAGCAGCAATAGAAATAGCAAC (SEQ ID NO: 2164) | OBD159_1661_1663 | 0.00077793 |
| 152 | OBD159_1663 | GTCACAGCAGCAATAGAAATAGCAAC (SEQ ID NO: 2164) | OBD159_1661_1663 | 0.00077793 |

TABLE 3.b8-continued

| | PCR-Primer2_ID | PCR_Primer2 | Marker | GLMNET |
|---|---|---|---|---|
| 153 | OBD159_1667 | GGAGGTGATGGTGATGTGCCAGC (SEQ ID NO: 2166) | OBD159_1665_1667 | 0.00207185 |
| 154 | OBD159_1667 | GGAGGTGATGGTGATGTGCCAGC (SEQ ID NO: 2166) | OBD159_1665_1667 | 0.00207185 |
| 155 | OBD159_1671 | GAGAAGTCCTGAAGTAACGCTAC (SEQ ID NO: 2168) | OBD159_1669_1671 | 0.000464028 |
| 156 | OBD159_1671 | GAGAAGTCCTGAAGTAACGCTAC (SEQ ID NO: 2168) | OBD159_1669_1671 | 0.000464028 |
| 157 | OBD159_1675 | AGGTGGACCGAGGGACATTTACCAGT (SEQ ID NO: 2170) | OBD159_1673_1675 | 0.000897879 |
| 158 | OBD159_1675 | AGGTGGACCGAGGGACATTTACCAGT (SEQ ID NO: 2170) | OBD159_1673_1675 | 0.000897879 |
| 159 | OBD159_1679 | CTTGTGAAGTCTTTATTATTATGCT (SEQ ID NO: 2172) | OBD159_1677_1679 | 0.001289242 |
| 160 | OBD159_1679 | CTTGTGAAGTCTTTATTATTATGCT (SEQ ID NO: 2172) | OBD159_1677_1679 | 0.001289242 |
| 161 | OBD159_1683 | TGCATTTTATATTGAAAAGTT (SEQ ID NO: 2174) | OBD159_1681_1683 | 0.001668215 |
| 162 | OBD159_1683 | TGCATTTTATATTGAAAAGTT (SEQ ID NO: 2174) | OBD159_1681_1683 | 0.001668215 |
| 163 | OBD159_1687 | AGTGTGCTTGGTTGAACTGAATCATT (SEQ ID NO: 610) | OBD159_1685_1687 | 0.00035722 |
| 164 | OBD159_1687 | AGTGTGCTTGGTTGAACTGAATCATT (SEQ ID NO: 610) | OBD159_1685_1687 | 0.00035722 |
| 165 | OBD159_1691 | GGAGGGCATAATCTCTGTTCTGCTGC (SEQ ID NO: 2178) | OBD159_1689_1691 | 0.002759986 |
| 166 | OBD159_1691 | GGAGGGCATAATCTCTGTTCTGCTGC (SEQ ID NO: 2178) | OBD159_1689_1691 | 0.002759986 |
| 167 | OBD159_1695 | GCCTTCTCCCCACACCTGGTATT (SEQ ID NO: 2180) | OBD159_1693_1695 | 0.000999054 |
| 168 | OBD159_1695 | GCCTTCTCCCCACACCTGGTATT (SEQ ID NO: 2180) | OBD159_1693_1695 | 0.000999054 |
| 169 | OBD159_1699 | CCCTAACCTCCCCACACCTCCTT (SEQ ID NO: 2182) | OBD159_1697_1699 | 0.001213842 |
| 170 | OBD159_1699 | CCCTAACCTCCCCACACCTCCTT (SEQ ID NO: 2182) | OBD159_1697_1699 | 0.001213842 |
| 171 | OBD159_1703 | CAGAATGGGTCCGTCTCAGAGGC (SEQ ID NO: 2184) | OBD159_1701_1703 | 0.001521449 |
| 172 | OBD159_1703 | CAGAATGGGTCCGTCTCAGAGGC (SEQ ID NO: 2184) | OBD159_1701_1703 | 0.001521449 |
| 173 | OBD159_1707 | TTTCAGCATAGATTTTGGGCGAAGGC (SEQ ID NO: 2186) | OBD159_1705_1707 | 0.001374847 |
| 174 | OBD159_1707 | TTTCAGCATAGATTTTGGGCGAAGGC (SEQ ID NO: 2186) | OBD159_1705_1707 | 0.001374847 |
| 175 | OBD159_1711 | GCAGATTTGGTGTGGGTTAGAGAGGG (SEQ ID NO: 2188) | OBD159_1709_1711 | 0.000546851 |
| 176 | OBD159_1711 | GCAGATTTGGTGTGGGTTAGAGAGGG (SEQ ID NO: 2188) | OBD159_1709_1711 | 0.000546851 |
| 177 | OBD159_1715 | AAGGAGCGTTGCGGAATGGGAGC (SEQ ID NO: 2190) | OBD159_1713_1715 | 0.000535081 |
| 178 | OBD159_1715 | AAGGAGCGTTGCGGAATGGGAGC (SEQ ID NO: 2190) | OBD159_1713_1715 | 0.000535081 |

TABLE 3.b8-continued

| | PCR-Primer2_ID | PCR_Primer2 | Marker | GLMNET |
|---|---|---|---|---|
| 179 | OBD159_1719 | GTTTGTGTCCTTCCCTCTCCCTAT (SEQ ID NO: 2192) | OBD159_1717_1719 | 0.001341809 |
| 180 | OBD159_1719 | GTTTGTGTCCTTCCCTCTCCCTAT (SEQ ID NO: 2192) | OBD159_1717_1719 | 0.001341809 |
| 181 | OBD159_1723 | GCCTGGGCTATTAGAAACAGCATCAG (SEQ ID NO: 2194) | OBD159_1721_1723 | 0.000916266 |
| 182 | OBD159_1723 | GCCTGGGCTATTAGAAACAGCATCAG (SEQ ID NO: 2194) | OBD159_1721_1723 | 0.000916266 |
| 183 | OBD159_1727 | CTTTTGGGAGACCGTAGGATTTGTAG (SEQ ID NO: 2196) | OBD159_1725_1727 | 0.001245559 |
| 184 | OBD159_1727 | CTTTTGGGAGACCGTAGGATTTGTAG (SEQ ID NO: 2196) | OBD159_1725_1727 | 0.001245559 |
| 185 | OBD159_1731 | CCATCTCCTGCCCGAAGCCAGTT (SEQ ID NO: 2198) | OBD159_1729_1731 | 0.001401855 |
| 186 | OBD159_1731 | CCATCTCCTGCCCGAAGCCAGTT (SEQ ID NO: 2198) | OBD159_1729_1731 | 0.001401855 |
| 187 | OBD159_1735 | AAAATACCAGGCAGGTGGGAAGAAGG (SEQ ID NO: 2200) | OBD159_1733_1735 | 0.000773504 |
| 188 | OBD159_1735 | AAAATACCAGGCAGGTGGGAAGAAGG (SEQ ID NO: 2200) | OBD159_1733_1735 | 0.000773504 |
| 189 | OBD159_1739 | TTAGATGGATGAAAGAGATGAAAA (SEQ ID NO: 1248) | OBD159_1737_1739 | 0.000994481 |
| 190 | OBD159_1739 | TTAGATGGATGAAAGAGATGAAAA (SEQ ID NO: 1248) | OBD159_1737_1739 | 0.000994481 |
| 191 | OBD159_1743 | GATGGTTTCAGATACCTCCCAGATAC (SEQ ID NO: 2204) | OBD159_1741_1743 | 0.001549662 |
| 192 | OBD159_1743 | GATGGTTTCAGATACCTCCCAGATAC (SEQ ID NO: 2204) | OBD159_1741_1743 | 0.001549662 |
| 193 | OBD159_1747 | ATGGAAACTGGGAGAGGAGACAGC (SEQ ID NO: 2206) | OBD159_1745_1747 | 0.002285957 |
| 194 | OBD159_1747 | ATGGAAACTGGGAGAGGAGACAGC (SEQ ID NO: 2206) | OBD159_1745_1747 | 0.002285957 |
| 195 | OBD159_1751 | TTACCTTACTCATTGAACAGTTTT (SEQ ID NO: 2208) | OBD159_1749_1751 | 0.001654806 |
| 196 | OBD159_1751 | TTACCTTACTCATTGAACAGTTTT (SEQ ID NO: 2208) | OBD159_1749_1751 | 0.001654806 |
| 197 | OBD159_1755 | GGGCATTGGAAGTTCAAGCGACTAAC (SEQ ID NO: 2210) | OBD159_1753_1755 | 0.001865788 |
| 198 | OBD159_1755 | GGGCATTGGAAGTTCAAGCGACTAAC (SEQ ID NO: 2210) | OBD159_1753_1755 | 0.001865788 |
| 199 | OBD159_1759 | CCCCAAATGCTTCACTCTGGAAAG (SEQ ID NO: 2212) | OBD159_1757_1759 | 0.001030812 |
| 200 | OBD159_1759 | CCCCAAATGCTTCACTCTGGAAAG (SEQ ID NO: 2212) | OBD159_1757_1759 | 0.001030812 |
| 201 | OBD159_1763 | GTGCTGCCCACCATCACTAAACAAAT (SEQ ID NO: 2214) | OBD159_1761_1763 | 0.000783894 |
| 202 | OBD159_1763 | GTGCTGCCCACCATCACTAAACAAAT (SEQ ID NO: 2214) | OBD159_1761_1763 | 0.000783894 |
| 203 | OBD159_1767 | CACATCTAACACTTGACAGCATTA (SEQ ID NO: 2216) | OBD159_1765_1767 | 0.001317268 |
| 204 | OBD159_1767 | CACATCTAACACTTGACAGCATTA (SEQ ID NO: 2216) | OBD159_1765_1767 | 0.001317268 |

TABLE 3.b8-continued

| | PCR-Primer2_ID | PCR_Primer2 | Marker | GLMNET |
|---|---|---|---|---|
| 205 | OBD159_1771 | GCTACCATTCTCTTTTGGCTTTGAGC (SEQ ID NO: 2218) | OBD159_1769_1771 | 0.00219463 |
| 206 | OBD159_1771 | GCTACCATTCTCTTTTGGCTTTGAGC (SEQ ID NO: 2218) | OBD159_1769_1771 | 0.00219463 |
| 207 | OBD159_1775 | CGGAGCAAGAGCAGTTTGGCTGTGT (SEQ ID NO: 2220) | OBD159_1773_1775 | 0.002134591 |
| 208 | OBD159_1775 | CGGAGCAAGAGCAGTTTGGCTGTGT (SEQ ID NO: 2220) | OBD159_1773_1775 | 0.002134591 |
| 209 | OBD159_1779 | ATAGCAGCCAGTCTCCACACCCC (SEQ ID NO: 2222) | OBD159_1777_1779 | 0.001397539 |
| 210 | OBD159_1779 | ATAGCAGCCAGTCTCCACACCCC (SEQ ID NO: 2222) | OBD159_1777_1779 | 0.001397539 |
| 211 | OBD159_1783 | AGGGTGGCAAATCAAACCTACCTGA (SEQ ID NO: 2224) | OBD159_1781_1783 | 0.000788302 |
| 212 | OBD159_1783 | AGGGTGGCAAATCAAACCTACCTGA (SEQ ID NO: 2224) | OBD159_1781_1783 | 0.000788302 |
| 213 | OBD159_1787 | GCCGTCCCAGTAATAACTAAATGC (SEQ ID NO: 2226) | OBD159_1785_1787 | 0.001998517 |
| 214 | OBD159_1787 | GCCGTCCCAGTAATAACTAAATGC (SEQ ID NO: 2226) | OBD159_1785_1787 | 0.001998517 |
| 215 | OBD159_1791 | GGGTATCTCTTGAACTGATGACTCTT (SEQ ID NO: 2228) | OBD159_1789_1791 | 0.001334933 |
| 216 | OBD159_1791 | GGGTATCTCTTGAACTGATGACTCTT (SEQ ID NO: 2228) | OBD159_1789_1791 | 0.001334933 |
| 217 | OBD159_1795 | CCCTCTATGGGTGCTCAGACTGC (SEQ ID NO: 2230) | OBD159_1793_1795 | 0.003048534 |
| 218 | OBD159_1795 | CCCTCTATGGGTGCTCAGACTGC (SEQ ID NO: 2230) | OBD159_1793_1795 | 0.003048534 |
| 219 | OBD159_1799 | ATGGAAATGATAAGTTGAAGGTAT (SEQ ID NO: 2232) | OBD159_1797_1799 | 0.00111867 |
| 220 | OBD159_1799 | ATGGAAATGATAAGTTGAAGGTAT (SEQ ID NO: 2232) | OBD159_1797_1799 | 0.00111867 |

TABLE 3.b9

| | Gene |
|---|---|
| 111 | ANKS1B; rs7960581 |
| 112 | ANKS1B; rs7960581 |
| 113 | TMEM242; ZDHHC14; rs181143083 |
| 114 | TMEM242; ZDHHC14; rs181143083 |
| 115 | CNTNAP2; rs201076428; rs6944808 |
| 116 | CNTNAP2; rs201076428; rs6944808 |
| 117 | MRPS6; SLC5A3; rs2834319 |
| 118 | MRPS6; SLC5A3; rs2834319 |
| 119 | rs1907240; rs2257129; rs3943077; rs35668226 |
| 120 | rs1907240; rs2257129; rs3943077; rs35668226 |
| 121 | GHR; rs6898743 |
| 122 | GHR; rs6898743 |
| 123 | RNF145; rs2901184; rs10515778; rs55801554 |
| 124 | RNF145; rs2901184; rs10515778; rs55801554 |
| 125 | NR2F2; rs2398180; rs587777373 |
| 126 | NR2F2; rs2398180; rs587777373 |
| 127 | TULP4; rs9456307 |
| 128 | TULP4; rs9456307 |
| 129 | GPR183; UBAC2; rs9557195; rs9513593 |
| 130 | GPR183; UBAC2; rs9557195; rs9513593 |
| 131 | PVRL1; TRIM29 |
| 132 | PVRL1; TRIM29 |
| 133 | DLST; PROX2; YLPM1 |

TABLE 3.b9-continued

| Gene |
|---|
| 134 DLST; PROX2; YLPM1 |
| 135 FGFR2; rs749474548; rs1057519795; rs1057520029; rs1057520027; rs879253720; rs121918508; rs1057519047; rs1057519854; rs777169135; rs121918509; rs1057519796; rs751047267; rs121918506; rs1057519797; rs121913476; rs1057519045; rs1057519901; rs1057519798; rs1057519799; rs1057519800; rs121918507; rs1057520044; rs751731391; rs387906677; rs1057519900; rs387906678; rs121913478; rs1057520028; rs121913477; rs879253721; rs121918490; rs121918502; rs121918494; rs121918491; rs121918492; rs121918496; rs121918487; rs121918488; rs121918495; rs121918489; rs1057519044; rs1057519043; rs387906676; rs1057519042; rs121918493; rs121918510; rs121918504; rs1057519791; rs121913475; rs1057519040; rs374608214; rs121918500; rs121918499; rs1057519039; rs121918501; rs121918497; rs1057519038; rs776587763; rs1057519036; rs879253718; rs121918505; rs779326224; rs387907372; rs77543610; rs121918498; rs79184941; rs3135753; rs11199993; rs755001161; rs148514974; rs10510097; rs4752569 |
| 136 FGFR2; rs749474548; rs1057519795; rs1057520029; rs1057520027; rs879253720; rs121918508; rs1057519047; rs1057519854; rs777169135; rs121918509; rs1057519796; rs751047267; rs121918506; rs1057519797; rs121913476; rs1057519045; rs1057519901; rs1057519798; rs1057519799; rs1057519800; rs121918507; rs1057520044; rs751731391; rs387906677; rs1057519900; rs387906678; rs121913478; rs1057520028; rs121913477; rs879253721; rs121918490; rs121918502; rs121918494; rs121918491; rs121918492; rs121918496; rs121918487; rs121918488; rs121918495; rs121918489; rs1057519044; rs1057519043; rs387906676; rs1057519042; rs121918493; rs121918510; rs121918504; rs1057519791; rs121913475; rs1057519040; rs374608214; rs121918500; rs121918499; rs1057519039; rs121918501; rs121918497; rs1057519038; rs776587763; rs1057519036; rs879253718; rs121918505; rs779326224; rs387907372; rs77543610; rs121918498; rs79184941; rs3135753; rs11199993; rs755001161; rs148514974; rs10510097; rs4752569 |
| 137 SGCG; rs76916029; rs764468720; rs138880406; rs781760379; rs200502077; rs797045106; rs570169794 |
| 138 SGCG; rs76916029; rs764468720; rs138880406; rs781760379; rs200502077; rs797045106; rs570169794 |
| 139 CPB2; ZC3H13; rs1926447; rs779491029; rs3742264 |
| 140 CPB2; ZC3H13; rs1926447; rs779491029; rs3742264 |
| 141 NR2F2; rs2398180; rs587777373 |
| 142 NR2F2; rs2398180; rs587777373 |
| 143 ACTR2; SPRED2; rs62139085 |
| 144 ACTR2; SPRED2; rs62139085 |
| 145 CTNNA2; rs6738962; rs13427272 |
| 146 CTNNA2; rs6738962; rs13427272 |
| 147 rs7771911 |
| 148 rs7771911 |
| 149 RBM33; SHH |
| 150 RBM33; SHH |
| 151 PLCB1; rs4432538 |
| 152 PLCB1; rs4432538 |
| 153 C5orf47; CPEB4; rs10516107; rs6861681; rs17076724; rs17076726; rs56163845; rs72812846; rs72812861 |
| 154 C5orf47; CPEB4; rs10516107; rs6861681; rs17076724; rs17076726; rs56163845; rs72812846; rs72812861 |
| 155 ASZ1; WNT2; rs114167782; rs749398878; rs3779547 |
| 156 ASZ1; WNT2; rs114167782; rs749398878; rs3779547 |
| 157 FAM160A1; SH3D19 |
| 158 FAM160A1; SH3D19 |
| 159 IBTK; rs10806235 |
| 160 IBTK; rs10806235 |
| 161 CFAP43; GSTO1; GSTO2; rs11191972; rs4925 |
| 162 CFAP43; GSTO1; GSTO2; rs11191972; rs4925 |
| 163 LRRTM4; rs61354037 |
| 164 LRRTM4; rs61354037 |
| 165 ST6GALNAC3; rs12095069 |
| 166 ST6GALNAC3; rs12095069 |
| 167 RERE; rs301807; rs301797; rs301798; rs172531; rs34976449; rs301819; rs159963; rs142472947; rs4908760; rs301806 |
| 168 RERE; rs301807; rs301797; rs301798; rs172531; rs34976449; rs301819; rs159963; rs142472947; rs4908760; rs301806 |
| 169 SFRP5; ZFYVE27; rs7072751 |
| 170 SFRP5; ZFYVE27; rs7072751 |
| 171 CAPS2; KCNC2 |
| 172 CAPS2; KCNC2 |
| 173 FAM124A; SERPINE3 |
| 174 FAM124A; SERPINE3 |
| 175 HMG20A; PEAK1 |
| 176 HMG20A; PEAK1 |
| 177 USP29; ZIM2 |
| 178 USP29; ZIM2 |
| 179 ALCAM; rs13070790 |
| 180 ALCAM; rs13070790 |
| 181 RFTN1; rs3856834 |
| 182 RFTN1; rs3856834 |
| 183 FAT4; rs1039808 |
| 184 FAT4; rs1039808 |
| 185 rs196458; rs116146467 |
| 186 rs196458; rs116146467 |
| 187 EBAG9; SYBU |
| 188 EBAG9; SYBU |
| 189 FBXO16; FZD3; rs17059209 |
| 190 FBXO16; FZD3; rs17059209 |
| 191 PAK3; rs121434612; rs780775497; rs121434613 |
| 192 PAK3; rs121434612; rs780775497; rs121434613 |
| 193 ATL2; CYP1B1 |

TABLE 3.b9-continued

| Gene |
| --- |
| 194 ATL2; CYP1B1 |
| 195 FRK; NT5DC1; rs1933737; rs9488822; rs3822857; rs868943; rs6909746; rs1999930 |
| 196 FRK; NT5DC1; rs1933737; rs9488822; rs3822857; rs868943; rs6909746; rs1999930 |
| 197 ATL2; CYP1B1 |
| 198 ATL2; CYP1B1 |
| 199 BIN3; EGR3; rs2280104 |
| 200 BIN3; EGR3; rs2280104 |
| 201 OPCML; rs7104890; rs4379857 |
| 202 OPCML; rs7104890; rs4379857 |
| 203 FRY; ZAR1L; rs56404467; rs56084662 |
| 204 FRY; ZAR1L; rs56404467; rs56084662 |
| 205 TMEM182; rs12105421 |
| 206 TMEM182; rs12105421 |
| 207 MAGI1; rs145965284 |
| 208 MAGI1; rs145965284 |
| 209 RAD51B; rs17105278; rs4902562; rs3784099; rs2208397; rs911263; rs2104047; rs1950897; rs11158728; rs927220; rs61985136; rs8017304; rs1956529; rs4902566; rs1570106 |
| 210 RAD51B; rs17105278; rs4902562; rs3784099; rs2208397; rs911263; rs2104047; rs1950897; rs11158728; rs927220; rs61985136; rs8017304; rs1956529; rs4902566; rs1570106 |
| 211 rs7542939 |
| 212 rs7542939 |
| 213 FGFR2; rs148514974; rs10510097; rs4752569; rs3750817; rs7895676; rs10736303; rs11200014; rs2981579; rs1078806; rs2981578; rs35054928; rs2981575; rs1219648; rs1219642; rs2912774; rs2936870; rs45631563; rs2420946; rs3135724; rs2981582; rs3135718; rs1219515; rs1696803; rs755001161 |
| 214 FGFR2; rs148514974; rs10510097; rs4752569; rs3750817; rs7895676; rs10736303; rs11200014; rs2981579; rs1078806; rs2981578; rs35054928; rs2981575; rs1219648; rs1219642; rs2912774; rs2936870; rs45631563; rs2420946; rs3135724; rs2981582; rs3135718; rs1219515; rs1696803; rs755001161 |
| 215 ENKUR; THNSL1 |
| 216 ENKUR; THNSL1 |
| 217 C10orf11; rs11593840; rs10509373 |
| 218 C10orf11; rs11593840; rs10509373 |
| 219 CLEC1A; CLEC7A; OLR1; rs16910526; rs16910527; rs7309123; rs2078178; rs3901533 |
| 220 CLEC1A; CLEC7A; OLR1; rs16910526; rs16910527; rs7309123; rs2078178; rs3901533 |

TABLE 3.c1

| Probe | GeneLocus |
| --- | --- |
| 221 ORF15_16_62560699_62565069_62586208_62592959_FF | rs150252171; rs288604 |
| 222 ORF15_16_62560699_62565069_62586208_62592959_FF | rs150252171; rs288604 |
| 223 ORF15_2_47506510_47507935_47549933_47552565_RR | KCNK12; MSH2; rs267608023 |
| 224 ORF15_2_47506510_47507935_47549933_47552565_RR | KCNK12; MSH2; rs267608023 |
| 225 ORF15_20_19844341_19848170_19898126_19900554_FR | RIN2; rs4813376; rs6046396; rs16981145 |
| 226 ORF15_20_19844341_19848170_19898126_19900554_FR | RIN2; rs4813376; rs6046396; rs16981145 |
| 227 ORF15_3_107655921_107658466_107697731_107699826_FF | BBX; rs11710737 |
| 228 ORF15_3_107655921_107658466_107697731_107699826_FF | BBX; rs11710737 |
| 229 ORF15_3_39211112_39215294_39286446_39287590_RF | CX3CR1; XIRP1; rs1877563; rs3732378; rs3732379; rs9868689; rs12636547; rs2669845; rs11715522; rs2853707 |
| 230 ORF15_3_39211112_39215294_39286446_39287590_RF | CX3CR1; XIRP1; rs1877563; rs3732378; rs3732379; rs9868689; rs12636547; rs2669845; rs11715522; rs2853707 |
| 231 ORF15_6_154255952_154259046_154307704_154312070_FF | CNKSR3; IPCEF1; OPRM1 |
| 232 ORF15_6_154255952_154259046_154307704_154312070_FF | CNKSR3; IPCEF1; OPRM1 |
| 233 ORF15_6_40454949_40456428_40488042_40490875_RR | LRFN2; rs148347825 |
| 234 ORF15_6_40454949_40456428_40488042_40490875_RR | LRFN2; rs148347825 |
| 235 ORF150_1_221097555_221099745_221139551_221141679_RF | rs12127195 |
| 236 ORF150_1_221097555_221099745_221139551_221141679_RF | rs12127195 |
| 237 ORF151_11_106693665_106699542_106725393_106728226_FF | GUCY1A2 |
| 238 ORF151_11_106693665_106699542_106725393_106728226_FF | GUCY1A2 |
| 239 ORF152_13_60846170_60855031_60904843_60913572_FR | TDRD3; rs7337573 |
| 240 ORF152_13_60846170_60855031_60904843_60913572_FR | TDRD3; rs7337573 |
| 241 ORF154_14_38203591_38207960_38231669_38243239_RF | CLEC14A; SSTR1; rs11622412 |
| 242 ORF154_14_38203591_38207960_38231669_38243239_RF | CLEC14A; SSTR1; rs11622412 |
| 243 ORF155_16_15155840_15159398_15192529_15195024_RF | PDXDC1; rs4003228 |
| 244 ORF155_16_15155840_15159398_15192529_15195024_RF | PDXDC1; rs4003228 |
| 245 ORF155_7_117353457_117366529_117423152_117425489_FR | ASZ1; WNT2; rs2188554; rs10249651 |
| 246 ORF155_7_117353457_117366529_117423152_117425489_FR | ASZ1; WNT2; rs2188554; rs10249651 |
| 247 ORF156_1_116579148_116582139_116593950_116598324_RR | CD58; IGSF3; rs724160030 |
| 248 ORF156_1_116579148_116582139_116593950_116598324_RR | CD58; IGSF3; rs724160030 |
| 249 ORF156_2_138025661_138027521_138071201_138075562_FF | HNMT |
| 250 ORF156_2_138025661_138027521_138071201_138075562_FF | HNMT |
| 251 ORF156_20_46570710_46574158_46643075_46649811_FR | SLC13A3; rs847058; rs6066043 |
| 252 ORF156_20_46570710_46574158_46643075_46649811_FR | SLC13A3; rs847058; rs6066043 |
| 253 ORF156_5_127434266_127436041_127460011_127467027_RR | MEGF10; rs387907071; rs387907072; |

TABLE 3.c1-continued

| Probe | GeneLocus |
|---|---|
| | rs199750143; rs794726678; rs989552169; rs794726677 |
| 254 ORF156_5_127434266_127436041_127460011_127467027_RR | MEGF10; rs387907071; rs387907072; rs199750143; rs794726678; rs989552169; rs794726677 |
| 255 ORF158_2_102946170_102956566_102980783_102983000_FR | TMEM182; rs12105421 |
| 256 ORF158_2_102946170_102956566_102980783_102983000_FR | TMEM182; rs12105421 |
| 257 ORF158_7_92986182_92992000_93038794_93043170_RR | rs12671937; rs739385 |
| 258 ORF158_7_92986182_92992000_93038794_93043170_RR | rs12671937; rs739385 |
| 259 ORF159_11_84067130_84068735_84133096_84135736_FF | DLG2; rs790356 |
| 260 ORF159_11_84067130_84068735_84133096_84135736_FF | DLG2; rs790356 |
| 261 ORF16_1_35676542_35678104_35750293_35751842_RF | C1orf216; CLSPN; PSMB2 |
| 262 ORF16_1_35676542_35678104_35750293_35751842_RF | C1orf216; CLSPN; PSMB2 |
| 263 ORF16_1_59152323_59153557_59201894_59205260_RF | rs12144699; rs6700125 |
| 264 ORF16_1_59152323_59153557_59201894_59205260_RF | rs12144699; rs6700125 |
| 265 ORF16_10_82866083_82869829_82889344_82893485_RR | NRG3; rs17101017; rs17685233 |
| 266 ORF16_10_82866083_82869829_82889344_82893485_RR | NRG3; rs17101017; rs17685233 |
| 267 ORF16_15_42499291_42501030_42536264_42540825_FR | HAUS2; LRRC57; SNAP23 |
| 268 ORF16_15_42499291_42501030_42536264_42540825_FR | HAUS2; LRRC57; SNAP23 |
| 269 ORF16_2_209522065_209524486_209555031_209561510_FF | MAP2; rs9288410 |
| 270 ORF16_2_209522065_209524486_209555031_209561510_FF | MAP2; rs9288410 |
| 271 ORF16_2_46531602_46534170_46569163_46570628_FR | ATP6V1E2; PIGF; RHOQ |
| 272 ORF16_2_46531602_46534170_46569163_46570628_FR | ATP6V1E2; PIGF; RHOQ |
| 273 ORF16_4_37859966_37862832_37889307_37892348_FR | GAFA3; PGM2; TBC1D1; rs17578878 |
| 274 ORF16_4_37859966_37862832_37889307_37892348_FR | GAFA3; PGM2; TBC1D1; rs17578878 |
| 275 ORF16_5_124808480_124814364_124880024_124884131_FF | ZNF608; rs4357030 |
| 276 ORF16_5_124808480_124814364_124880024_124884131_FF | ZNF608; rs4357030 |
| 277 ORF16_5_74305244_74313564_74325511_74329920_RF | rs167025; rs80337801 |
| 278 ORF16_5_74305244_74313564_74325511_74329920_RF | rs167025; rs80337801 |
| 279 ORF16_6_137345960_137347521_137362789_137365756_RR | OLIG3; rs13201877 |
| 280 ORF16_6_137345960_137347521_137362789_137365756_RR | OLIG3; rs13201877 |
| 281 ORF160_3_67234045_67246290_67291641_67297587_FR | KBTBD8; SUCLG2 |
| 282 ORF160_3_67234045_67246290_67291641_67297587_FR | KBTBD8; SUCLG2 |
| 283 ORF161_3_192744752_192746116_192807100_192810430_FR | FGF12; MB21D2 |
| 284 ORF161_3_192744752_192746116_192807100_192810430_FR | FGF12; MB21D2 |
| 285 ORF161_4_59264971_59267015_59339329_59348337_RF | NA |
| 286 ORF161_4_59264971_59267015_59339329_59348337_RF | NA |
| 287 ORF162_X_39303922_39309694_39331263_39333882_FF | rs5917854 |
| 288 ORF162_X_39303922_39309694_39331263_39333882_FF | rs5917854 |
| 289 ORF163_2_209684451_209692640_209735707_209738646_FF | MAP2; UNC80; rs146432517 |
| 290 ORF163_2_209684451_209692640_209735707_209738646_FF | MAP2; UNC80; rs146432517 |
| 291 ORF164_15_58557606_58564146_58584664_58585981_FF | LIPC; rs113298164; rs1365771; rs60439253; rs6494025; rs7178362 |
| 292 ORF164_15_58557606_58564146_58584664_58585981_FF | LIPC; rs113298164; rs1365771; rs60439253; rs6494025; rs7178362 |
| 293 ORF165_13_97124956_97128666_97195242_97199543_RF | MBNL2; OXGR1 |
| 294 ORF165_13_97124956_97128666_97195242_97199543_RF | MBNL2; OXGR1 |
| 295 ORF165_5_159344811_159354581_159378555_159380399_FF | rs953861; rs6556411; rs6556412; rs4379175; rs10045431 |
| 296 ORF165_5_159344811_159354581_159378555_159380399_FF | rs953861; rs6556411; rs6556412; rs4379175; rs10045431 |
| 297 ORF169_7_93011591_93016612_93036188_93038794_RF | rs12671937; rs739385 |
| 298 ORF169_7_93011591_93016612_93036188_93038794_RF | rs12671937; rs739385 |
| 299 ORF17_1_69089823_69102269_69164723_69166979_RR | rs9436866; rs10789285 |
| 300 ORF17_1_69089823_69102269_69164723_69166979_RR | rs9436866; rs10789285 |
| 301 ORF17_1_76000194_76003911_76083373_76086337_FF | ST6GALNAC3; rs12095069 |
| 302 ORF17_1_76000194_76003911_76083373_76086337_FF | ST6GALNAC3; rs12095069 |
| 303 ORF17_12_75136236_75139196_75166435_75186315_RR | CAPS2; KCNC2 |
| 304 ORF17_12_75136236_75139196_75166435_75186315_RR | CAPS2; KCNC2 |
| 305 ORF17_13_33822756_33828516_33873349_33876786_RR | RFC3; rs12429186 |
| 306 ORF17_13_33822756_33828516_33873349_33876786_RR | RFC3; rs12429186 |
| 307 ORF17_19_46479838_46481514_46541191_46545048_FF | PNMAL1; PNMAL2; PPP5D1 |
| 308 ORF17_19_46479838_46481514_46541191_46545048_FF | PNMAL1; PNMAL2; PPP5D1 |
| 309 ORF17_2_5850709_5859559_5924503_5932342_RF | rs16864170; rs10929925 |
| 310 ORF17_2_5850709_5859559_5924503_5932342_RF | rs16864170; rs10929925 |
| 311 ORF17_22_25661627_25666380_25694410_25695479_FF | ADRBK2; rs8142284; rs12158587 |
| 312 ORF17_22_25661627_25666380_25694410_25695479_FF | ADRBK2; rs8142284; rs12158587 |
| 313 ORF17_4_125340607_125343598_125357325_125363715_RR | FAT4; rs1039808 |
| 314 ORF17_4_125340607_125343598_125357325_125363715_RR | FAT4; rs1039808 |
| 315 ORF17_5_74294290_74298111_74386498_74391810_RF | rs80337801; rs12517545; rs167025 |
| 316 ORF17_5_74294290_74298111_74386498_74391810_RF | rs80337801; rs12517545; rs167025 |
| 317 ORF17_6_482421_486539_555690_558488_FR | EXOC2; rs116446171; rs950039; rs9392056; rs6918152; rs2476847; rs12210050 |
| 318 ORF17_6_482421_486539_555690_558488_FR | EXOC2; rs116446171; rs950039; rs9392056; rs6918152; rs2476847; rs12210050 |
| 319 ORF17_8_10100695_10103743_10175271_10177408_FF | MSRA; rs10087178; rs10107815; rs73191547; rs7012397 |
| 320 ORF17_8_10100695_10103743_10175271_10177408_FF | MSRA; rs10087178; rs10107815; rs73191547; |

TABLE 3.c1-continued

| Probe | GeneLocus |
|---|---|
| | rs7012397 |
| 321 ORF17_8_21022651_21025530_21054445_21056962_RR | rs500816; rs7015657 |
| 322 ORF17_8_21022651_21025530_21054445_21056962_RR | rs500816; rs7015657 |
| 323 ORF173_2_172799773_172804834_172831811_172834823_FR | RAPGEF4; rs733331 |
| 324 ORF173_2_172799773_172804834_172831811_172834823_FR | RAPGEF4; rs733331 |
| 325 ORF174_1_66141924_66143825_66164982_66168816_RF | PDE4B; rs490094 |
| 326 ORF174_1_66141924_66143825_66164982_66168816_RF | PDE4B; rs490094 |
| 327 ORF174_12_96219857_96223649_96237099_96241349_RR | ELK3; rs4762284 |
| 328 ORF174_12_96219857_96223649_96237099_96241349_RR | ELK3; rs4762284 |
| 329 ORF174_13_97124956_97128666_97147277_97152656_RR | MBNL2; OXGR1 |
| 330 ORF174_13_97124956_97128666_97147277_97152656_RR | MBNL2; OXGR1 |

TABLE 3.c2

| | Probe_Count_Total | Probe_Count_Sig | HyperG_Stats |
|---|---|---|---|
| 221 | NA | NA | NA |
| 222 | NA | NA | NA |
| 223 | 60; 53; NA | 1; 1; 1; 1; NA | 0.22379944; 0.199487628; 0.261255041; 0.238249082; NA |
| 224 | 60; 53; NA | 1; 1; 1; 1; NA | 0.22379944; 0.199487628; 0.261255041; 0.238249082; NA |
| 225 | 175; NA | 4; 4; NA | 0.096861772; 0.075450093; NA |
| 226 | 175; NA | 4; 4; NA | 0.096861772; 0.075450093; NA |
| 227 | 30; NA | 4; 5; NA | 0.022454364; 0.006393518; NA |
| 228 | 30; NA | 4; 5; NA | 0.022454364; 0.006393518; NA |
| 229 | 48; 46; NA | 1; 1; 1; 1; NA | 0.288729231; 0.267628012; 0.299630226; 0.279547236; NA |
| 230 | 48; 46; NA | 1; 1; 1; 1; NA | 0.288729231; 0.267628012; 0.299630226; 0.279547236; NA |
| 231 | 163; 163; 140 | 4; 2; 4; 2; 4; 2 | 0.117375195; 0.022678142; 0.117375195; 0.022678142; 0.158806697; 0.045194146 |
| 232 | 163; 163; 140 | 4; 2; 4; 2; 4; 2 | 0.117375195; 0.022678142; 0.117375195; 0.022678142; 0.158806697; 0.045194146 |
| 233 | 45; NA | 1; 1; NA | 0.305019886; 0.285503815; NA |
| 234 | 45; NA | 1; 1; NA | 0.305019886; 0.285503815; NA |
| 235 | NA | NA | NA |
| 236 | NA | NA | NA |
| 237 | 36 | 1; 1 | 0.349116343; 0.336492635 |
| 238 | 36 | 1; 1 | 0.349116343; 0.336492635 |
| 239 | 1; NA | 1; 1; NA | 0.038988153; 0.042102538; NA |
| 240 | 1; NA | 1; 1; NA | 0.038988153; 0.042102538; NA |
| 241 | 43; 49; NA | 1; 1; 1; 1; NA | 0.315614698; 0.297350686; 0.283240383; 0.261686551; NA |
| 242 | 43; 49; NA | 1; 1; 1; 1; NA | 0.315614698; 0.297350686; 0.283240383; 0.261686551; NA |
| 243 | 38; NA | 2; 1; NA | 0.255573168; 0.325888812; NA |
| 244 | 38; NA | 2; 1; NA | 0.255573168; 0.325888812; NA |
| 245 | 23; 23; NA | 2; 2; 2; 2; NA | 0.166907425; 0.181828486; 0.166907425; 0.181828486; NA |
| 246 | 23; 23; NA | 2; 2; 2; 2; NA | 0.166907425; 0.181828486; 0.166907425; 0.181828486; NA |
| 247 | 22; 23; NA | 1; 1; 1; 1; NA | 0.372324987; 0.375573766; 0.374075448; 0.376115439; NA |
| 248 | 22; 23; NA | 1; 1; 1; 1; NA | 0.372324987; 0.375573766; 0.374075448; 0.376115439; NA |
| 249 | 12 | 1; 1 | 0.302214299; 0.314913912 |
| 250 | 12 | 1; 1 | 0.302214299; 0.314913912 |
| 251 | 117; NA | 2; 3; NA | 0.106169317; 0.143969124; NA |
| 252 | 117; NA | 2; 3; NA | 0.106169317; 0.143969124; NA |
| 253 | 26; NA | 3; 3; NA | 0.061689421; 0.072111; NA |
| 254 | 26; NA | 3; 3; NA | 0.061689421; 0.072111; NA |
| 255 | 27; NA | 2; 3; NA | 0.197546356; 0.077717327; NA |
| 256 | 27; NA | 2; 3; NA | 0.197546356; 0.077717327; NA |
| 257 | NA | NA | NA |
| 258 | NA | NA | NA |
| 259 | 22; NA | 3; 3; NA | 0.042821316; 0.050708849; NA |
| 260 | 22; NA | 3; 3; NA | 0.042821316; 0.050708849; NA |
| 261 | 50; 83; 12 | 1; 1; 1; 1; 1; 1 | 0.277739605; 0.255769837; 0.123780263; 0.102353336; 0.302214299; 0.314913912 |
| 262 | 50; 83; 12 | 1; 1; 1; 1; 1; 1 | 0.277739605; 0.255769837; 0.123780263; 0.102353336; 0.302214299; 0.314913912 |
| 263 | NA | NA | NA |
| 264 | NA | NA | NA |
| 265 | 22; NA | 1; 1; NA | 0.372324987; 0.375573766; NA |
| 266 | 22; NA | 1; 1; NA | 0.372324987; 0.375573766; NA |
| 267 | 41; 29; 26 | 1; 1; 1; 1; 1; 1 | 0.325868449; 0.309016356; 0.371537436; 0.366349054; 0.375314357; 0.373699919 |
| 268 | 41; 29; 26 | 1; 1; 1; 1; 1; 1 | 0.325868449; 0.309016356; 0.371537436; 0.366349054; 0.375314357; 0.373699919 |
| 269 | 60; NA | 5; 7; NA | 0.05512946; 0.009185497; NA |
| 270 | 60; NA | 5; 7; NA | 0.05512946; 0.009185497; NA |
| 271 | 33; 25; 37 | 1; 1; 1; 1; 1; 1 | 0.360592644; 0.35096223; 0.375519541; 0.375121431; 0.34481748; 0.331269672 |
| 272 | 33; 25; 37 | 1; 1; 1; 1; 1; 1 | 0.360592644; 0.35096223; 0.375519541; 0.375121431; 0.34481748; |

TABLE 3.c2-continued

| | Probe_Count_Total | Probe_Count_Sig | HyperG_Stats |
|---|---|---|---|
| | | | 0.331269672 |
| 273 | 37; 37; 40; NA | 5; 8; 5; 8; 2; 3; NA | 0.010942367; 0.000107113; 0.010942367; 0.000107113; 0.261899069; 0.150241062; NA |
| 274 | 37; 37; 40; NA | 5;8;5; 8; 2; 3; NA | 0.010942367; 0.000107113; 0.010942367; 0.000107113; 0.261899069; 0.150241062; NA |
| 275 | 48; NA | 1; 1; NA | 0.288729231; 0.267628012; NA |
| 276 | 48; NA | 1; 1; NA | 0.288729231; 0.267628012; NA |
| 277 | NA | NA | NA |
| 278 | NA | NA | NA |
| 279 | 70; NA | 1; 1; NA | 0.175291065; 0.151233777; NA |
| 280 | 70; NA | 1; 1; NA | 0.175291065; 0.151233777; NA |
| 281 | 22; 8 | 1; 1; 1; 1 | 0.372324987; 0.375573766; 0.236185646; 0.249326315 |
| 282 | 22; 8 | 1; 1; 1; 1 | 0.372324987; 0.375573766; 0.236185646; 0.249326315 |
| 283 | 22; 22 | 1; 1; 1; 1 | 0.372324987; 0.375573766; 0.372324987; 0.375573766 |
| 284 | 22; 22 | 1; 1; 1; 1 | 0.372324987; 0.375573766; 0.372324987; 0.375573766 |
| 285 | NA | NA | NA |
| 286 | NA | NA | NA |
| 287 | NA | NA | NA |
| 288 | NA | NA | NA |
| 289 | 60; 35; NA | 5; 7; 1; 1; NA | 0.05512946; 0.009185497; 0.353195365; 0.341533433; NA |
| 290 | 60; 35; NA | 5; 7; 1; 1; NA | 0.05512946; 0.009185497; 0.353195365; 0.341533433; NA |
| 291 | 12; NA | 1; 1; NA | 0.302214299; 0.314913912; NA |
| 292 | 12; NA | 1; 1; NA | 0.302214299; 0.314913912; NA |
| 293 | 62; 12 | 2; 2; 2; 2 | 0.264714788; 0.254031269; 0.067384485; 0.076075379 |
| 294 | 62; 12 | 2; 2; 2; 2 | 0.264714788; 0.254031269; 0.067384485; 0.076075379 |
| 295 | NA | NA | NA |
| 296 | NA | NA | NA |
| 297 | NA | NA | NA |
| 298 | NA | NA | NA |
| 299 | NA | NA | NA |
| 300 | NA | NA | NA |
| 301 | 45; NA | 5; 5; NA | 0.022343156; 0.028833151; NA |
| 302 | 45; NA | 5; 5; NA | 0.022343156; 0.028833151; NA |
| 303 | 13; 13 | 4; 4; 4; 4 | 0.001148684; 0.001517434; 0.001148684; 0.001517434 |
| 304 | 13; 13 | 4; 4; 4; 4 | 0.001148684; 0.001517434; 0.001148684; 0.001517434 |
| 305 | 17; NA | 1; 2; NA | 0.350975055; 0.126473611; NA |
| 306 | 17; NA | 1; 2; NA | 0.350975055; 0.126473611; NA |
| 307 | 28; 32; 32 | 3; 4; 3; 4; 3; 4 | 0.071800115; 0.02285211; 0.09275567; 0.033810966; 0.09275567; 0.033810966 |
| 308 | 28; 32; 32 | 3; 4; 3; 4; 3; 4 | 0.071800115; 0.02285211; 0.09275567; 0.033810966; 0.09275567; 0.033810966 |
| 309 | NA | NA | NA |
| 310 | NA | NA | NA |
| 311 | 110; NA | 1; 4; NA | 0.055848211; 0.190296804; NA |
| 312 | 110; NA | 1; 4; NA | 0.055848211; 0.190296804; NA |
| 313 | 19; NA | 3; 4; NA | 0.030348034; 0.006361707; NA |
| 314 | 19; NA | 3; 4; NA | 0.030348034; 0.006361707; NA |
| 315 | NA | NA | NA |
| 316 | NA | NA | NA |
| 317 | 25; NA | 1; 1; NA | 0.375519541; 0.375121431; NA |
| 318 | 25; NA | 1; 1; NA | 0.375519541; 0.375121431; NA |
| 319 | 115; NA | 4; 4; NA | 0.193790369; 0.18374459; NA |
| 320 | 115; NA | 4; 4; NA | 0.193790369; 0.18374459; NA |
| 321 | NA | NA | NA |
| 322 | NA | NA | NA |
| 323 | 30; NA | 1; 1; NA | 0.36936157; 0.363021342; NA |
| 324 | 30; NA | 1; 1; NA | 0.36936157; 0.363021342; NA |
| 325 | 17; NA | 3; 2; NA | 0.023054538; 0.126473611; NA |
| 326 | 17; NA | 3; 2; NA | 0.023054538; 0.126473611; NA |
| 327 | 13; NA | 2; 3; NA | 0.076537269; 0.013853987; NA |
| 328 | 13; NA | 2; 3; NA | 0.076537269; 0.013853987; NA |
| 329 | 62; 12 | 2; 2; 2; 2 | 0.264714788; 0.254031269; 0.067384485; 0.076075379 |
| 330 | 62; 12 | 2; 2; 2; 2 | 0.264714788; 0.254031269; 0.067384485; 0.076075379 |

TABLE 3.c3

| | FDR_HyperG | Percent_Sig | logFC | AveExpr |
|---|---|---|---|---|
| 221 | NA | NA | −0.726698111 | −0.726698111 |
| 222 | NA | NA | −0.726057795 | −0.726057795 |
| 223 | 0.375519541; 0.376115439; 0.375519541; 0.376115439; NA | 1.67; 1.67; 1.89; 1.89; NA | −0.972967521 | −0.972967521 |
| 224 | 0.375519541; 0.376115439; 0.375519541; 0.376115439; NA | 1.67; 1.67; 1.89; 1.89; NA | −0.970348937 | −0.970348937 |
| 225 | 0.375519541; 0.376115439; NA | 2.29; 2.29; NA | −0.759303568 | −0.759303568 |

TABLE 3.c3-continued

| | FDR_HyperG | Percent_Sig | logFC | AveExpr |
|---|---|---|---|---|
| 226 | 0.375519541; 0.376115439; NA | 2.29; 2.29; NA | −0.714670963 | −0.714670963 |
| 227 | 0.375519541; 0.217379602; NA | 13.33; 16.67; NA | −0.845291244 | −0.845291244 |
| 228 | 0.375519541; 0.217379602; NA | 13.33; 16.67; NA | −0.737301237 | −0.737301237 |
| 229 | 0.375519541; 0.376115439; 0.375519541; 0.376115439; NA | 2.08; 2.08; 2.17; 2.17; NA | −0.808158746 | −0.808158746 |
| 230 | 0.375519541; 0.376115439; 0.375519541; 0.376115439; NA | 2.08; 2.08; 2.17; 2.17; NA | −0.771402868 | −0.771402868 |
| 231 | 0.375519541; 0.376115439; 0.375519541; 0.376115439; 0.375519541; 0.376115439 | 2.45; 1.23; 2.45; 1.23; 2.86; 1.43 | −0.973554656 | −0.973554656 |
| 232 | 0.375519541; 0.376115439; 0.375519541; 0.376115439; 0.375519541; 0.376115439 | 2.45; 1.23; 2.45; 1.23; 2.86; 1.43 | −0.744378809 | −0.744378809 |
| 233 | 0.375519541; 0.376115439; NA | 2.22; 2.22; NA | −0.750559533 | −0.750559533 |
| 234 | 0.375519541; 0.376115439; NA | 2.22; 2.22; NA | −0.747547131 | −0.747547131 |
| 235 | NA | NA | −1.515895749 | −1.515895749 |
| 236 | NA | NA | −1.463401445 | −1.463401445 |
| 237 | 0.375519541; 0.376115439 | 2.78; 2.78 | −0.969964962 | −0.969964962 |
| 238 | 0.375519541; 0.376115439 | 2.78; 2.78 | −0.85652158 | −0.85652158 |
| 239 | 0.375519541; 0.376115439; NA | 100; 100; NA | −0.831727698 | −0.831727698 |
| 240 | 0.375519541; 0.376115439; NA | 100; 100; NA | −0.760675915 | −0.760675915 |
| 241 | 0.375519541; 0.376115439; 0.375519541; 0.376115439; NA | 2.33; 2.33; 2.04; 2.04; NA | −1.07314694 | −1.07314694 |
| 242 | 0.375519541; 0.376115439; 0.375519541; 0.376115439; NA | 2.33; 2.33; 2.04; 2.04; NA | −0.941218749 | −0.941218749 |
| 243 | 0.375519541; 0.376115439; NA | 5.26; 2.63; NA | −0.759263952 | −0.759263952 |
| 244 | 0.375519541; 0.376115439; NA | 5.26; 2.63; NA | −0.722790727 | −0.722790727 |
| 245 | 0.375519541; 0.376115439; 0.375519541; 0.376115439; NA | 8.7; 8.7; 8.7; 8.7; NA | −0.790564324 | −0.790564324 |
| 246 | 0.375519541; 0.376115439; 0.375519541; 0.376115439; NA | 8.7; 8.7; 8.7; 8.7; NA | −0.775827182 | −0.775827182 |
| 247 | 0.375519541; 0.376115439; 0.375519541; 0.376115439; NA | 4.55; 4.55; 4.35; 4.35; NA | −0.899938733 | −0.899938733 |
| 248 | 0.375519541; 0.376115439; 0.375519541; 0.376115439; NA | 4.55; 4.55; 4.35; 4.35; NA | −0.896218026 | −0.896218026 |
| 249 | 0.375519541; 0.376115439 | 8.33; 8.33 | −1.179694021 | −1.179694021 |
| 250 | 0.375519541; 0.376115439 | 8.33; 8.33 | −0.97212929 | −0.97212929 |
| 251 | 0.375519541; 0.376115439; NA | 1.71; 2.56; NA | −0.78521903 | −0.78521903 |
| 252 | 0.375519541; 0.376115439; NA | 1.71; 2.56; NA | −0.743346757 | −0.743346757 |
| 253 | 0.375519541; 0.376115439; NA | 11.54; 11.54; NA | −0.971200525 | −0.971200525 |
| 254 | 0.375519541; 0.376115439; NA | 11.54; 11.54; NA | −0.831127148 | −0.831127148 |
| 255 | 0.375519541; 0.376115439; NA | 7.41; 11.11; NA | −1.370319868 | −1.370319868 |
| 256 | 0.375519541; 0.376115439; NA | 7.41; 11.11; NA | −1.3514784 | −1.3514784 |
| 257 | NA | NA | −0.778719679 | −0.778719679 |
| 258 | NA | NA | −0.691828819 | −0.691828819 |
| 259 | 0.375519541; 0.376115439; NA | 13.64; 13.64; NA | −0.909665705 | −0.909665705 |
| 260 | 0.375519541; 0.376115439; NA | 13.64; 13.64; NA | −0.796673674 | −0.796673674 |
| 261 | 0.375519541; 0.376115439; 0.375519541; 0.376115439; 0.375519541; 0.376115439 | 2; 2; 1.2; 1.2; 8.33; 8.33 | −0.734466175 | −0.734466175 |
| 262 | 0.375519541; 0.376115439; 0.375519541; 0.376115439; 0.375519541; 0.376115439 | 2; 2; 1.2; 1.2; 8.33; 8.33 | −0.706471144 | −0.706471144 |
| 263 | NA | NA | −0.907101553 | −0.907101553 |
| 264 | NA | NA | −0.769675227 | −0.769675227 |
| 265 | 0.375519541; 0.376115439; NA | 4.55; 4.55; NA | −0.816029888 | −0.816029888 |
| 266 | 0.375519541; 0.376115439; NA | 4.55; 4.55; NA | −0.712243866 | −0.712243866 |
| 267 | 0.375519541; 0.376115439; 0.375519541; 0.376115439; 0.375519541; 0.376115439 | 2.44; 2.44; 3.45; 3.45; 3.85; 3.85 | −0.957971684 | −0.957971684 |
| 268 | 0.375519541; 0.376115439; 0.375519541; 0.376115439; 0.375519541; 0.376115439 | 2.44; 2.44; 3.45; 3.45; 3.85; 3.85 | −0.858499735 | −0.858499735 |
| 269 | 0.375519541; 0.275564898; NA | 8.33; 11.67; NA | −0.798611058 | −0.798611058 |
| 270 | 0.375519541; 0.275564898; NA | 8.33; 11.67; NA | −0.776769251 | −0.776769251 |
| 271 | 0.375519541; 0.376115439; 0.375519541; 0.376115439; 0.375519541; 0.376115439 | 3.03; 3.03; 4; 4; 2.7; 2.7 | −0.897770765 | −0.897770765 |
| 272 | 0.375519541; 0.376115439; 0.375519541; 0.376115439; 0.375519541; 0.376115439 | 3.03; 3.03; 4; 4; 2.7; 2.7 | −0.764254297 | −0.764254297 |
| 273 | 0.357678624; 0.013656923; 0.357678624; 0.013656923; 0.375519541; 0.376115439; NA | 13.51; 21.62; 13.51; 21.62; 5; 7.5; NA | −1.836212004 | −1.836212004 |
| 274 | 0.357678624; 0.013656923; 0.357678624; 0.013656923; 0.375519541; 0.376115439; NA | 13.51; 21.62; 13.51; 21.62; 5; 7.5; NA | −1.603541061 | −1.603541061 |
| 275 | 0.375519541; 0.376115439; NA | 2.08; 2.08; NA | −1.468540904 | −1.468540904 |
| 276 | 0.375519541; 0.376115439; NA | 2.08; 2.08; NA | −1.070675584 | −1.070675584 |
| 277 | NA | NA | −1.461923568 | −1.461923568 |
| 278 | NA | NA | −1.403737685 | −1.403737685 |
| 279 | 0.375519541; 0.376115439; NA | 1.43; 1.43; NA | −1.002714272 | −1.002714272 |
| 280 | 0.375519541; 0.376115439; NA | 1.43; 1.43; NA | −0.938173563 | −0.938173563 |
| 281 | 0.375519541; 0.376115439; 0.375519541; 0.376115439 | 4.55; 4.55; 12.5; 12.5 | −0.711833222 | −0.711833222 |
| 282 | 0.375519541; 0.376115439; 0.375519541; 0.376115439 | 4.55; 4.55; 12.5; 12.5 | −0.672072705 | −0.672072705 |
| 283 | 0.375519541; 0.376115439; 0.375519541; 0.376115439 | 4.55; 4.55; 4.55; 4.55 | −0.846490154 | −0.846490154 |

TABLE 3.c3-continued

| | FDR_HyperG | Percent_Sig | logFC | AveExpr |
|---|---|---|---|---|
| 284 | 0.375519541; 0.376115439; 0.375519541; 0.376115439 | 4.55; 4.55; 4.55; 4.55 | −0.774817701 | −0.774817701 |
| 285 | NA | NA | −1.003303154 | −1.003303154 |
| 286 | NA | NA | −0.715984515 | −0.715984515 |
| 287 | NA | NA | −0.82136057 | −0.82136057 |
| 288 | NA | NA | −0.746382779 | −0.746382779 |
| 289 | 0.375519541; 0.275564898; 0.375519541; 0.376115439; NA | 8.33; 11.67; 2.86; 2.86; NA | −0.83262013 | −0.83262013 |
| 290 | 0.375519541; 0.275564898; 0.375519541; 0.376115439; NA | 8.33; 11.67; 2.86; 2.86; NA | −0.707142612 | −0.707142612 |
| 291 | 0.375519541; 0.376115439; NA | 8.33; 8.33; NA | −0.864175665 | −0.864175665 |
| 292 | 0.375519541; 0.376115439; NA | 8.33; 8.33; NA | −0.725027539 | −0.725027539 |
| 293 | 0.375519541; 0.376115439; 0.375519541; 0.376115439 | 3.23; 3.23; 16.67; 16.67 | −0.727163704 | −0.727163704 |
| 294 | 0.375519541; 0.376115439; 0.375519541; 0.376115439 | 3.23; 3.23; 16.67; 16.67 | −0.701856007 | −0.701856007 |
| 295 | NA | NA | −1.215854511 | −1.215854511 |
| 296 | NA | NA | −1.117529237 | −1.117529237 |
| 297 | NA | NA | −0.877425807 | −0.877425807 |
| 298 | NA | NA | −0.740291846 | −0.740291846 |
| 299 | NA | NA | −1.056331907 | −1.056331907 |
| 300 | NA | NA | −0.93331802 | −0.93331802 |
| 301 | 0.375519541; 0.376115439; NA | 11.11; 11.11; NA | −0.960387084 | −0.960387084 |
| 302 | 0.375519541; 0.376115439; NA | 11.11; 11.11; NA | −0.739716304 | −0.739716304 |
| 303 | 0.069549998; 0.082088441; 0.069549998; 0.082088441 | 30.77; 30.77; 30.77; 30.77 | −0.83350941 | −0.83350941 |
| 304 | 0.069549998; 0.082088441; 0.069549998; 0.082088441 | 30.77; 30.77; 30.77; 30.77 | −0.817702142 | −0.817702142 |
| 305 | 0.375519541; 0.376115439; NA | 5.88; 11.76; NA | −1.040949661 | −1.040949661 |
| 306 | 0.375519541; 0.376115439; NA | 5.88; 11.76; NA | −0.969050047 | −0.969050047 |
| 307 | 0.375519541; 0.376115439; 0.375519541; 0.376115439; 0.375519541; 0.376115439 | 10.71; 14.29; 9.38; 12.5; 9.38; 12.5 | −1.005430659 | −1.005430659 |
| 308 | 0.375519541; 0.376115439; 0.375519541; 0.376115439; 0.375519541; 0.376115439 | 10.71; 14.29; 9.38; 12.5; 9.38; 12.5 | −0.864780498 | −0.864780498 |
| 309 | NA | NA | −1.070122518 | −1.070122518 |
| 310 | NA | NA | −0.968555139 | −0.968555139 |
| 311 | 0.375519541; 0.376115439; NA | 0.91; 3.64; NA | −1.040267643 | −1.040267643 |
| 312 | 0.375519541; 0.376115439; NA | 0.91; 3.64; NA | −0.829513074 | −0.829513074 |
| 313 | 0.375519541; 0.217379602; NA | 15.79; 21.05; NA | −0.882508243 | −0.882508243 |
| 314 | 0.375519541; 0.217379602; NA | 15.79; 21.05; NA | −0.707959382 | −0.707959382 |
| 315 | NA | NA | −0.989337766 | −0.989337766 |
| 316 | NA | NA | −0.835094075 | −0.835094075 |
| 317 | 0.375519541; 0.376115439; NA | 4; 4; NA | −1.085573197 | −1.085573197 |
| 318 | 0.375519541; 0.376115439; NA | 4; 4; NA | −0.672666103 | −0.672666103 |
| 319 | 0.375519541; 0.376115439; NA | 3.48; 3.48; NA | −1.39412829 | −1.39412829 |
| 320 | 0.375519541; 0.376115439; NA | 3.48; 3.48; NA | −1.358173278 | −1.358173278 |
| 321 | NA | NA | −0.846081071 | −0.846081071 |
| 322 | NA | NA | −0.750491323 | −0.750491323 |
| 323 | 0.375519541; 0.376115439; NA | 3.33; 3.33; NA | −0.947673241 | −0.947673241 |
| 324 | 0.375519541; 0.376115439; NA | 3.33; 3.33; NA | −0.783071343 | −0.783071343 |
| 325 | 0.375519541; 0.376115439; NA | 17.65; 11.76; NA | −1.383777574 | −1.383777574 |
| 326 | 0.375519541; 0.376115439; NA | 17.65; 11.76; NA | −0.941911055 | −0.941911055 |
| 327 | 0.375519541; 0.376115439; NA | 15.38; 23.08; NA | −0.780409932 | −0.780409932 |
| 328 | 0.375519541; 0.376115439; NA | 15.38; 23.08; NA | −0.775260334 | −0.775260334 |
| 329 | 0.375519541; 0.376115439; 0.375519541; 0.376115439 | 3.23; 3.23; 16.67; 16.67 | −0.787045617 | −0.787045617 |
| 330 | 0.375519541; 0.376115439; 0.375519541; 0.376115439 | 3.23; 3.23; 16.67; 16.67 | −0.71359646 | −0.71359646 |

TABLE 3.c4

| | T | P.Value | adj.P.Val | B | FC | FC_1 | LS |
|---|---|---|---|---|---|---|---|
| 221 | −15.09502527 | 0.00000000387 | 0.00000354 | 11.49687023 | 0.604285357 | −1.654847313 | −1 |
| 222 | −10.24932946 | 0.000000278 | 0.0000182 | 7.309460357 | 0.604553619 | −1.654113 | −1 |
| 223 | −4.796617416 | 0.000442557 | 0.004121332 | −0.183920012 | 0.509457067 | −1.962873938 | −1 |
| 224 | −14.67225906 | 0.00000000510 | 0.00000207 | 11.28105246 | 0.510382604 | −1.959314427 | −1 |
| 225 | −4.305065536 | 0.001035003 | 0.007382021 | −1.052020008 | 0.59078145 | −1.692673323 | −1 |
| 226 | −6.554004906 | 0.0000273 | 0.000337583 | 2.597998805 | 0.60934409 | −1.641108885 | −1 |
| 227 | −10.91571236 | 0.00000014 | 0.000012 | 8.004066765 | 0.556598434 | −1.796627403 | −1 |
| 228 | −9.658227518 | 0.000000544 | 0.0000513 | 6.668613592 | 0.599860426 | −1.667054461 | −1 |
| 229 | −5.324291463 | 0.000184319 | 0.002243312 | 0.714501349 | 0.571110278 | −1.750975316 | −1 |
| 230 | −4.848291313 | 0.000401145 | 0.002265984 | −0.175440037 | 0.585847523 | −1.706928784 | −1 |
| 231 | −5.838884332 | 0.0000815 | 0.001272083 | 1.553702329 | 0.509249775 | −1.963672933 | −1 |
| 232 | −8.479699536 | 0.00000208 | 0.0000633 | 5.252788304 | 0.596924838 | −1.675252789 | −1 |
| 233 | −5.05278884 | 0.000287874 | 0.003050707 | 0.256863106 | 0.594372992 | −1.682445221 | −1 |

TABLE 3.c4-continued

| | T | P.Value | adj.P.Val | B | FC | FC_1 | LS |
|---|---|---|---|---|---|---|---|
| 234 | −5.130176991 | 0.000250236 | 0.001602292 | 0.310504266 | 0.595615362 | −1.678935877 | −1 |
| 235 | −12.39535418 | 0.0000000342 | 0.00000549 | 9.413458414 | 0.349679288 | −2.859763314 | −1 |
| 236 | −14.21195153 | 0.00000000767 | 0.00000485 | 10.85135629 | 0.36263713 | −2.757577525 | −1 |
| 237 | −8.089141457 | 0.00000339 | 0.0000858 | 4.752323254 | 0.510518461 | −1.958793023 | −1 |
| 238 | −8.257617798 | 0.00000281 | 0.000142122 | 5.004014461 | 0.552282539 | −1.810667421 | −1 |
| 239 | −11.35524954 | 0.0000000906 | 0.00000926 | 8.441011886 | 0.561855989 | −1.779815503 | −1 |
| 240 | −6.172971569 | 0.0000489 | 0.000899687 | 2.078339821 | 0.590219743 | −1.694284225 | −1 |
| 241 | −8.960821697 | 0.00000117 | 0.000044 | 5.844968081 | 0.47528114 | −2.104017844 | −1 |
| 242 | −7.193624257 | 0.0000113 | 0.000341309 | 3.583441139 | 0.520792743 | −1.920149644 | −1 |
| 243 | −9.908768536 | 0.0000004 | 0.0000225 | 6.938595898 | 0.590797673 | −1.692626844 | −1 |
| 244 | −8.184308062 | 0.00000308 | 0.000150742 | 4.910698978 | 0.605924217 | −1.650371402 | −1 |
| 245 | −6.662779622 | 0.0000233 | 0.000305263 | 2.761039155 | 0.578117911 | −1.729750939 | −1 |
| 246 | −9.077710492 | 0.00000105 | 0.0000764 | 6.004990049 | 0.584053656 | −1.712171458 | −1 |
| 247 | −8.234686551 | 0.00000282 | 0.0000764 | 4.940953894 | 0.535909489 | −1.865986738 | −1 |
| 248 | −7.256379754 | 0.0000104 | 0.000323016 | 3.671302969 | 0.537293382 | −1.861180564 | −1 |
| 249 | −8.472209255 | 0.0000021 | 0.0000636 | 5.243359837 | 0.441445114 | −2.265287279 | −1 |
| 250 | −6.303172515 | 0.0000402 | 0.000790002 | 2.278482958 | 0.509753157 | −1.961733805 | −1 |
| 251 | −6.921533194 | 0.0000161 | 0.000239242 | 3.142313066 | 0.580263855 | −1.723353939 | −1 |
| 252 | −7.058019872 | 0.0000136 | 0.000386075 | 3.391271466 | 0.597352009 | −1.674054802 | −1 |
| 253 | −7.795288638 | 0.00000494 | 0.000109876 | 4.363578625 | 0.510081427 | −1.960471304 | −1 |
| 254 | −6.513057223 | 0.0000295 | 0.000644848 | 2.59604273 | 0.562089921 | −1.779074774 | −1 |
| 255 | −11.37148718 | 0.0000000925 | 0.0000177 | 8.435677674 | 0.386805478 | −2.585278794 | −1 |
| 256 | −8.586000536 | 0.00000183 | 0.0000583 | 5.385894109 | 0.391890254 | −2.551734802 | −1 |
| 257 | −5.792701812 | 0.0000862 | 0.00074495 | 1.410356705 | 0.582883845 | −1.71560768 | −1 |
| 258 | −9.104696077 | 0.00000102 | 0.0000749 | 6.036636344 | 0.619068596 | −1.615329879 | −1 |
| 259 | −8.45165409 | 0.00000216 | 0.0000647 | 5.217452206 | 0.532308421 | −1.878610144 | −1 |
| 260 | −6.054564483 | 0.0005585 | 0.001016568 | 1.894224705 | 0.575674944 | −1.73709141 | −1 |
| 261 | −5.51188889 | 0.000136271 | 0.00180854 | 1.024769019 | 0.60104038 | −1.663781724 | −1 |
| 262 | −6.501548418 | 0.0000295 | 0.000355217 | 2.518783878 | 0.612817268 | −1.631807803 | −1 |
| 263 | −9.754862412 | 0.000000474 | 0.0000251 | 6.767298674 | 0.533255353 | −1.875274191 | −1 |
| 264 | −7.338035998 | 0.00000928 | 0.00030197 | 3.784839448 | 0.586549501 | −1.704885944 | −1 |
| 265 | −3.314059132 | 0.006189686 | 0.017780919 | −2.959508843 | 0.568002865 | −1.7605545 | −1 |
| 266 | −4.2954428 | 0.001052681 | 0.00747151 | −1.069277796 | 0.610370074 | −1.638350311 | −1 |
| 267 | −7.059717062 | 0.0000133 | 0.000209886 | 3.342182682 | 0.514780145 | −1.942576864 | −1 |
| 268 | −12.47149186 | 0.0000000333 | 0.0000102 | 9.438927188 | 0.551525794 | −1.813151825 | −1 |
| 269 | −7.618329677 | 0.00000624 | 0.00012779 | 4.12426192 | 0.574902393 | −1.739425703 | −1 |
| 270 | −8.605887581 | 0.00000183 | 0.000108855 | 5.438567497 | 0.583672398 | −1.713289859 | −1 |
| 271 | −12.97814091 | 0.0000000204 | 0.00000415 | 9.923470568 | 0.536715417 | −1.863184787 | −1 |
| 272 | −10.07716341 | 0.000000345 | 0.0000388 | 7.126039298 | 0.588757608 | −1.698491852 | −1 |
| 273 | −15.83292475 | 0.00000000213 | 0.00000133 | 12.11652346 | 0.280056146 | −3.570712564 | −1 |
| 274 | −16.38350644 | 0.00000000152 | 0.00000227 | 12.3642491 | 0.329068295 | −3.038882853 | −1 |
| 275 | −11.59799178 | 0.0000000717 | 0.00000816 | 8.675486503 | 0.36134757 | −2.76741864 | −1 |
| 276 | −5.280146015 | 0.000198038 | 0.002356397 | 0.640776841 | 0.476096001 | −2.100416719 | −1 |
| 277 | −10.63452615 | 0.000000186 | 0.0000143 | 7.715867407 | 0.363008801 | −2.754754147 | −1 |
| 278 | −11.83049363 | 0.0000000598 | 0.0000136 | 8.865717964 | 0.377948696 | −2.645861757 | −1 |
| 279 | −9.372973884 | 0.000000726 | 0.0000329 | 6.331952557 | 0.499060189 | −2.003766321 | −1 |
| 280 | −6.77459111 | 0.0000203 | 0.000504023 | 2.983065863 | 0.521893174 | −1.916100938 | −1 |
| 281 | −6.485153998 | 0.0000302 | 0.000360864 | 2.493944705 | 0.610543832 | −1.637884042 | −1 |
| 282 | −7.023767292 | 0.0000143 | 0.000398328 | 3.342966879 | 0.627604367 | −1.593360488 | −1 |
| 283 | −5.563719206 | 0.000123743 | 0.000961403 | 1.037121649 | 0.556136082 | −1.798121059 | −1 |
| 284 | −9.298866893 | 0.000000814 | 0.0000651 | 6.262016494 | 0.584462472 | −1.710973839 | −1 |
| 285 | −5.704817415 | 0.000099 | 0.000821495 | 1.267980575 | 0.498856524 | −2.00458439 | −1 |
| 286 | −3.583083655 | 0.003791178 | 0.018250289 | −2.36730167 | 0.608789543 | −1.642603771 | −1 |
| 287 | −6.331086712 | 0.0000386 | 0.000767676 | 2.321077965 | 0.565907997 | −1.767071689 | −1 |
| 288 | −6.295755245 | 0.00004 | 0.000436154 | 2.204291448 | 0.596096258 | −1.67758141 | −1 |
| 289 | −13.03241832 | 0.0000000195 | 0.00000406 | 9.969780502 | 0.56150854 | −1.780916814 | −1 |
| 290 | −10.13766846 | 0.000000323 | 0.0000376 | 7.190678617 | 0.612532114 | −1.632567465 | −1 |
| 291 | −5.152045201 | 0.000241351 | 0.001559694 | 0.347767929 | 0.549360214 | −1.820299277 | −1 |
| 292 | −6.515394415 | 0.0000294 | 0.000643302 | 2.599543863 | 0.604985496 | −1.652932188 | −1 |
| 293 | −8.172223732 | 0.00000305 | 0.0000804 | 4.86031352 | 0.604090371 | −1.655381459 | −1 |
| 294 | −6.309718116 | 0.0000399 | 0.000784214 | 2.288481009 | 0.614780791 | −1.62659604 | −1 |
| 295 | −8.842688633 | 0.00000134 | 0.0000482 | 5.701981752 | 0.430518008 | −2.32278321 | −1 |
| 296 | −10.99328362 | 0.000000134 | 0.0000221 | 8.068314954 | 0.460882458 | −2.169750622 | −1 |
| 297 | −7.095796343 | 0.0000127 | 0.000202991 | 3.393943275 | 0.544337824 | −1.837094457 | −1 |
| 298 | −7.992355313 | 0.00000393 | 0.000175109 | 4.663255461 | 0.598618244 | −1.670513737 | −1 |
| 299 | −12.1895176 | 0.0000000413 | 0.00000598 | 9.227517438 | 0.480853089 | −2.079637258 | −1 |
| 300 | −10.17139509 | 0.000000312 | 0.0000369 | 7.226556964 | 0.52365262 | −1.909662938 | −1 |
| 301 | −10.09622433 | 0.000000327 | 0.00002 | 7.144106153 | 0.513919007 | −1.945831903 | −1 |
| 302 | −11.09860644 | 0.000000121 | 0.0000206 | 8.171836565 | 0.598857102 | −1.669847442 | −1 |
| 303 | −8.411534972 | 0.00000227 | 0.0000667 | 5.166743952 | 0.561162532 | −1.782014912 | −1 |
| 304 | −6.049342373 | 0.000059 | 0.001021499 | 1.886058513 | 0.567344864 | −1.762596374 | −1 |
| 305 | −8.464436493 | 0.00000212 | 0.0000641 | 5.233568882 | 0.486007452 | −2.05758162 | −1 |
| 306 | −7.634401178 | 0.00000399 | 0.000233236 | 4.189529526 | 0.51084232 | −1.957551207 | −1 |
| 307 | −8.008967166 | 0.00000385 | 0.000173339 | 4.684849003 | 0.498121415 | −2.00754268 | −1 |
| 308 | −6.246490908 | 0.0000431 | 0.000458332 | 2.128122037 | 0.549129949 | −1.821062576 | −1 |
| 309 | −10.43651407 | 0.000000228 | 0.0000161 | 7.508636121 | 0.47627855 | −2.099611664 | −1 |
| 310 | −10.75242162 | 0.000000171 | 0.0000257 | 7.827948595 | 0.511017591 | −1.956879796 | −1 |
| 311 | −11.69251984 | 0.0000000655 | 0.00000769 | 8.765520045 | 0.486237261 | −2.056609151 | −1 |

TABLE 3.c4-continued

|  | T | P.Value | adj.P.Val | B | FC | FC_1 | LS |
|---|---|---|---|---|---|---|---|
| 312 | −8.844888887 | 0.00000138 | 0.0000906 | 5.728620268 | 0.562719134 | −1.777085475 | −1 |
| 313 | −7.834384291 | 0.0000047 | 0.000106426 | 4.415917682 | 0.542423563 | −1.843577727 | −1 |
| 314 | −7.944981466 | 0.00000417 | 0.000181804 | 4.601486399 | 0.612185432 | −1.633491992 | −1 |
| 315 | −8.022939853 | 0.00000369 | 0.0000907 | 4.665673227 | 0.503708937 | −1.985273491 | −1 |
| 316 | −9.058879802 | 0.00000107 | 0.0000771 | 5.9828599 | 0.560546486 | −1.783973364 | −1 |
| 317 | −7.178072619 | 0.0000113 | 0.000188258 | 3.511326602 | 0.471205016 | −2.122218493 | −1 |
| 318 | −5.784807352 | 0.0000886 | 0.00134607 | 1.467280723 | 0.627346278 | −1.594015992 | −1 |
| 319 | −16.56621545 | 0.00000000134 | 0.00000216 | 12.48065645 | 0.38047451 | −2.628296962 | −1 |
| 320 | −20.48448052 | 0.000000000108 | 0.00000039 | 14.86398276 | 0.390075886 | −2.563603736 | −1 |
| 321 | −9.460539812 | 0.000000658 | 0.0000307 | 6.433098271 | 0.556293799 | −1.797611266 | −1 |
| 322 | −12.12127333 | 0.0000000457 | 0.000012 | 9.129577314 | 0.594401094 | −1.682365678 | −1 |
| 323 | −7.915940352 | 0.00000423 | 0.0000992 | 4.524485486 | 0.518467966 | −1.928759471 | −1 |
| 324 | −9.257002532 | 0.000000854 | 0.0000673 | 6.213766102 | 0.581128316 | −1.720790354 | −1 |
| 325 | −10.91294799 | 0.00000014 | 0.000012 | 8.001266796 | 0.383214067 | −2.609507547 | −1 |
| 326 | −5.834260864 | 0.000082 | 0.001278013 | 1.5463298 | 0.52054289 | −1.921071286 | −1 |
| 327 | −8.463521893 | 0.00000212 | 0.0000642 | 5.232416344 | 0.582201341 | −1.717618853 | −1 |
| 328 | −6.017103925 | 0.0000519 | 0.001056554 | 1.835558518 | 0.584283181 | −1.711498863 | −1 |
| 329 | −12.98333109 | 0.0000000212 | 0.00000816 | 9.875172609 | 0.579529651 | −1.725537249 | −1 |
| 330 | −10.28382014 | 0.000000268 | 0.0000179 | 7.346405373 | 0.609798091 | −1.639887061 | −1 |

TABLE 3.c5

|  | Loop Detected | Probe sequence 60 mer | Probe Location Chr |
|---|---|---|---|
| 221 | mAD | CTAAGAACTTGACAATTTCATAAGGCTTTCGATGGGCCTAGCTTGGCTCTAAGCACTTTA (SEQ ID NO: 2234) | 16 |
| 222 | sAD | CTAAGAACTTGACAATTTCATAAGGCTTTCGATGGGCCTAGCTTGGCTCTAAGCACTTTA (SEQ ID NO: 2234) | 16 |
| 223 | mAD | AGCAAAAAGTGAAGACTGCTTGACTTTTTCGAAAAAAAAAAAAAAGGAAAAATATCATGTC (SEQ ID NO: 2236) | 2 |
| 224 | sAD | AGCAAAAAGTGAAGACTGCTTGACTTTTTCGAAAAAAAAAAAAAAGGAAAAATATCATGTC (SEQ ID NO: 2236) | 2 |
| 225 | mAD | GTTAAGTGGTGTACTTTTTGAAAATCCATCGAACAGAAATTCCTTTTCATATTTTCAAAA (SEQ ID NO: 2238) | 20 |
| 226 | sAD | GTTAAGTGGTGTACTTTTTGAAAATCCATCGAACAGAAATTCCTTTTCATATTTTCAAAA (SEQ ID NO: 2238) | 20 |
| 227 | sAD | GGAATGAATAATAAATTTCCTGTCATTGTCGAGAAAATATCTTGTCTGGGCCAGGCCTCT (SEQ ID NO: 2240) | 3 |
| 228 | mAD | GGAATGAATAATAAATTTCCTGTCATTGTCGAGAAAATATCTTGTCTGGGCCAGGCCTCT (SEQ ID NO: 2240) | 3 |
| 229 | mAD | TGTTTTAGTGCCTTCAGCACATTTATTTTCGATTTTAGCCCCATAAAACTATTTTCAGAT (SEQ ID NO: 2242) | 3 |
| 230 | sAD | TGTTTTAGTGCCTTCAGCACATTTATTTTCGATTTTAGCCCCATAAAACTATTTTCAGAT (SEQ ID NO: 2242) | 3 |
| 231 | mAD | GACAGATGTCTGCAAAGCCATCTACTGCTCGATGGACAAAGATTGATTGCATATCTTGGC (SEQ ID NO: 2244) | 6 |
| 232 | sAD | GACAGATGTCTGCAAAGCCATCTACTGCTCGATGGACAAAGATTGATTGCATATCTTGGC (SEQ ID NO: 2244) | 6 |
| 233 | mAD | ACCTTTCAAAAAATTTCTGGCTTATACATCGAAAAGGAGAGGGAATATTTTCTTTTGTTG (SEQ ID NO: 2246) | 6 |
| 234 | sAD | ACCTTTCAAAAAATTTCTGGCTTATACATCGAAAAGGAGAGGGAATATTTTCTTTTGTTG (SEQ ID NO: 2246) | 6 |
| 235 | sAD | GATGAAATGATTTTGCTATTGTCATACATCGATTTTTTTTTCTTTAGTAACAGAAAAAAT (SEQ ID NO: 2248) | 1 |
| 236 | mAD | GATGAAATGATTTTGCTATTGTCATACATCGATTTTTTTTTCTTTAGTAACAGAAAAAAT (SEQ ID NO: 2248) | 1 |
| 237 | sAD | CAGATGTCTCCCATATAAATAGGAATTATCGAATAGGAAATTGTTAGGTAATTAAGGTAG | 11 |

TABLE 3.c5-continued

| | Loop Detected | Probe sequence 60 mer | Probe Location Chr |
|---|---|---|---|
| | | (SEQ ID NO: 2250) | |
| 238 | mAD | CAGATGTCTCCCATATAAATAGGAATTATCGAATAGGAAATTGTTAGGTAATTAAGGTAG (SEQ ID NO: 2250) | 11 |
| 239 | sAD | GTGATAATCCTATTTGTAGTATAGATTATCGATAGATGCAGAAAAGGTCTTCAATAAAAT (SEQ ID NO: 2252) | 13 |
| 240 | mAD | GTGATAATCCTATTTGTAGTATAGATTATCGATAGATGCAGAAAAGGTCTTCAATAAAAT (SEQ ID NO: 2252) | 13 |
| 241 | sAD | AGGAATTAAAACTGTTGAAACTTTAGTCTCGAGACAATAGTTTTAAACTAATGCATCCAT (SEQ ID NO: 2254) | 14 |
| 242 | mAD | AGGAATTAAAACTGTTGAAACTTTAGTCTCGAGACAATAGTTTTAAACTAATGCATCCAT (SEQ ID NO: 2254) | 14 |
| 243 | sAD | ATTATAACATCTATAAAGAAAAATACCCTCGAAAAAAAAAAAATGGAAAAAGAAAAAAA (SEQ ID NO: 2256) | 16 |
| 244 | mAD | ATTATAACATCTATAAAGAAAAATACCCTCGAAAAAAAAAAAATGGAAAAAGAAAAAAA (SEQ ID NO: 2256) | 16 |
| 245 | sAD | ATAAAGAGCTCGGAAGTGAGCTCTTTAGTCGAATGACAAGCAGTGAGCTAAAATAAAGGG (SEQ ID NO: 2258) | 7 |
| 246 | mAD | ATAAAGAGCTCGGAAGTGAGCTCTTTAGTCGAATGACAAGCAGTGAGCTAAAATAAAGGG (SEQ ID NO: 2258) | 7 |
| 247 | sAD | AACATACCATATAATCTTTATAATAAACTCGAATGACATTCATATGGGCAAAAATTATGC (SEQ ID NO: 2260) | 1 |
| 248 | mAD | AACATACCATATAATCTTTATAATAAACTCGAATGACATTCATATGGGCAAAAATTATGC (SEQ ID NO: 2260) | 1 |
| 249 | sAD | TATCTTCTCTTCTTTCTCCATGAAAAAATCGATGAGGGGATATTTATTTGTTTTGTAACC (SEQ ID NO: 2262) | 2 |
| 250 | mAD | TATCTTCTCTTCTTTCTCCATGAAAAAATCGATGAGGGGATATTTATTTGTTTTGTAACC (SEQ ID NO: 2262) | 2 |
| 251 | sAD | GTAGCTGATTCAGTGGTGTTTATAAAGATCGAGACATACTTATGAGCACCTACTATGTGC (SEQ ID NO: 2264) | 20 |
| 252 | mAD | GTAGCTGATTCAGTGGTGTTTATAAAGATCGAGACATACTTATGAGCACCTACTATGTGC (SEQ ID NO: 2264) | 20 |
| 253 | sAD | CTTTAAGAGTCGTTTCTGGCAATAAAAATCGAATTTAATTTGACATTGATGTCACTCTTC (SEQ ID NO: 2266) | 5 |
| 254 | mAD | CTTTAAGAGTCGTTTCTGGCAATAAAAATCGAATTTAATTTGACATTGATGTCACTCTTC (SEQ ID NO: 2266) | 5 |
| 255 | mAD | TTCTCTTCTTTATTGCATTAATCTGGTTTCGATTTTCTCTTCTCTTTATAAAGGTTTTTT (SEQ ID NO: 2268) | 2 |
| 256 | sAD | TTCTCTTCTTTATTGCATTAATCTGGTTTCGATTTTCTCTTCTCTTTATAAAGGTTTTTT (SEQ ID NO: 2268) | 2 |
| 257 | sAD | ATTATTGCTGTTATTGTTATTCTTGCTATCGATGGAACAGAAAAAGAATGCAAAGAGACA (SEQ ID NO: 2270) | 7 |
| 258 | mAD | ATTATTGCTGTTATTGTTATTCTTGCTATCGATGGAACAGAAAAAGAATGCAAAGAGACA (SEQ ID NO: 2270) | 7 |
| 259 | sAD | CTCATTATACTGAGTTTATTTGTTTTATTCGACCTCTCACTGAAGCTTCCAGCTCATTTC (SEQ ID NO: 2272) | 11 |
| 260 | mAD | CTCATTATACTGAGTTTATTTGTTTTATTCGACCTCTCACTGAAGCTTCCAGCTCATTTC (SEQ ID NO: 2272) | 11 |
| 261 | mAD | ACCTATATTAAAGAAAAAGAGAAACGACTCGACTCTGTCTCAAAAAAATAAATAAAATAA (SEQ ID NO: 2274) | 1 |
| 262 | sAD | ACCTATATTAAAGAAAAAGAGAAACGACTCGACTCTGTCTCAAAAAAATAAATAAAATAA (SEQ ID NO: 2274) | 1 |

TABLE 3.c5-continued

| | Loop Detected | Probe sequence 60 mer | Probe Location Chr |
|---|---|---|---|
| 263 | sAD | CAGAAGGATCTCATCATTTAAAAAAATCTCGAAAAGCTTTTCTACCACTTCCCAGTAAAT (SEQ ID NO: 2276) | 1 |
| 264 | mAD | CAGAAGGATCTCATCATTTAAAAAAATCTCGAAAAGCTTTTCTACCACTTCCCAGTAAAT (SEQ ID NO: 2276) | 1 |
| 265 | sAD | TGTTCTTTCTTCATTTAATGTATAACCATCGACTTCAGTAACTGAAAAGATGTTTTGAAC (SEQ ID NO: 2278) | 10 |
| 266 | mAD | TGTTCTTTCTTCATTTAATGTATAACCATCGACTTCAGTAACTGAAAAGATGTTTTGAAC (SEQ ID NO: 2278) | 10 |
| 267 | sAD | GACAGTGTTTTGGAAATTGAAATTACTTTCGATGTAGGGTTGCTACAAACTGTCTATTTG (SEQ ID NO: 2280) | 15 |
| 268 | mAD | GACAGTGTTTTGGAAATTGAAATTACTTTCGATGTAGGGTTGCTACAAACTGTCTATTTG (SEQ ID NO: 2280) | 15 |
| 269 | sAD | CTTTATGATAATTGCTATGTTAGTAGCCTCGAGACTCAGAGAGGTTAAATAACTTCTCCA (SEQ ID NO: 2282) | 2 |
| 270 | mAD | CTTTATGATAATTGCTATGTTAGTAGCCTCGAGACTCAGAGAGGTTAAATAACTTCTCCA (SEQ ID NO: 2282) | 2 |
| 271 | sAD | GCCTTCAAATCATCACCGTTAATCCTTTTCGAAACACTTGACCAGCTCTCTCATTTATCT (SEQ ID NO: 2284) | 2 |
| 272 | mAD | GCCTTCAAATCATCACCGTTAATCCTTTTCGAAACACTTGACCAGCTCTCTCATTTATCT (SEQ ID NO: 2284) | 2 |
| 273 | sAD | CCTACCAGAACTCTTAAATCTATAATATTCGACTAACTCCTCCGTAAAGAATAGCTACCA (SEQ ID NO: 2286) | 4 |
| 274 | mAD | CCTACCAGAACTCTTAAATCTATAATATTCGACTAACTCCTCCGTAAAGAATAGCTACCA (SEQ ID NO: 2286) | 4 |
| 275 | sAD | TAAAGAAATTTAAATTTAAAATGTATGCTCGATACTCTGTTTTCCAGGCATGTCTGCAGA (SEQ ID NO: 2288) | 5 |
| 276 | mAD | TAAAGAAATTTAAATTTAAAATGTATGCTCGATACTCTGTTTTCCAGGCATGTCTGCAGA (SEQ ID NO: 2288) | 5 |
| 277 | sAD | TTCCAAAATTCTGAGATTCTTAATTATGTCGAATTTGTCTAAGGTTTTTCTTTTAACACC (SEQ ID NO: 2290) | 5 |
| 278 | mAD | TTCCAAAATTCTGAGATTCTTAATTATGTCGAATTTGTCTAAGGTTTTTCTTTTAACACC (SEQ ID NO: 2290) | 5 |
| 279 | sAD | GAGAGGAAGCCTGTCTTTTCCAGGCTTCTCGAAAGGTAAGGCAGAGTGAGATGGAATCTA (SEQ ID NO: 2292) | 6 |
| 280 | mAD | GAGAGGAAGCCTGTCTTTTCCAGGCTTCTCGAAAGGTAAGGCAGAGTGAGATGGAATCTA (SEQ ID NO: 2292) | 6 |
| 281 | sAD | TTTTAAATCAATAACATTTTAGGGTAAGTCGATTCCTGACTCTTTTTTCTGTGGTTGTGA (SEQ ID NO: 2294) | 3 |
| 282 | mAD | TTTTAAATCAATAACATTTTAGGGTAAGTCGATTCCTGACTCTTTTTTCTGTGGTTGTGA (SEQ ID NO: 2294) | 3 |
| 283 | sAD | AAATACTACCTAGTAAACCCTTATTATCTCGATATATTATCAATATATTTTTTCCCATCA (SEQ ID NO: 2296) | 3 |
| 284 | mAD | AAATACTACCTAGTAAACCCTTATTATCTCGATATATTATCAATATATTTTTTCCCATCA (SEQ ID NO: 2296) | 3 |
| 285 | sAD | GCTTCTTTTCTTTTTTTTTTATATTACTTCGAAGGTGGAACTTAACCCTCCCCTTAAGAA (SEQ ID NO: 2298) | 4 |
| 286 | mAD | GCTTCTTTTCTTTTTTTTTTATATTACTTCGAAGGTGGAACTTAACCCTCCCCTTAAGAA (SEQ ID NO: 2298) | 4 |
| 287 | mAD | GACCACAAAGTGAAGGTAAAAATAAAATTCGAGAATTCAATACATCATGATTCTTTTTTA (SEQ ID NO: 2300) | X |

TABLE 3.c5-continued

| | Loop Detected | Probe sequence 60 mer | Probe Location Chr |
|---|---|---|---|
| 288 | sAD | GACCACAAAGTGAAGGTAAAAATAAAATTCGAGAATTCAATACATCATGATTCTTTTTTA (SEQ ID NO: 2300) | X |
| 289 | sAD | CCCGATTACTTCAGATTTACTTACAGCCTCGAGACTTCTTTTTATAACCAAATAATTTTA (SEQ ID NO: 2302) | 2 |
| 290 | mAD | CCCGATTACTTCAGATTTACTTACAGCCTCGAGACTTCTTTTTATAACCAAATAATTTTA (SEQ ID NO: 2302) | 2 |
| 291 | sAD | CTTTTAACAGATCACAATATCAAAAATCTCGAATGTCAACTGTTCTGGTTTTCATGTGAA (SEQ ID NO: 2304) | 15 |
| 292 | mAD | CTTTTAACAGATCACAATATCAAAAATCTCGAATGTCAACTGTTCTGGTTTTCATGTGAA (SEQ ID NO: 2304) | 15 |
| 293 | sAD | GAATAAACATGTGCATAGACAACCATTATCGATTAAAGGAAGATATCTGAGTACAAGCTG (SEQ ID NO: 2306) | 13 |
| 294 | mAD | GAATAAACATGTGCATAGACAACCATTATCGATTAAAGGAAGATATCTGAGTACAAGCTG (SEQ ID NO: 2306) | 13 |
| 295 | sAD | GTCTATCAGTTATCTGTTAAGTTTTGAATCGAGCAGAATACAGCCATATTTTTCTTCTTG (SEQ ID NO: 2308) | 5 |
| 296 | mAD | GTCTATCAGTTATCTGTTAAGTTTTGAATCGAGCAGAATACAGCCATATTTTTCTTCTTG (SEQ ID NO: 2308) | 5 |
| 297 | sAD | AAAATAAGTTGATAGAGGAAAGTATTATTCGAAGCTTGCTGGAATTGTGAGAAAAGTAAG (SEQ ID NO: 2310) | 7 |
| 298 | mAD | AAAATAAGTTGATAGAGGAAAGTATTATTCGAAGCTTGCTGGAATTGTGAGAAAAGTAAG (SEQ ID NO: 2310) | 7 |
| 299 | sAD | TGTTACAACTGAATTTGTTGCATTTTTCTCGAACCACCCTACATGAAAATGGGAAAAACA (SEQ ID NO: 2312) | 1 |
| 300 | mAD | TGTTACAACTGAATTTGTTGCATTTTTCTCGAACCACCCTACATGAAAATGGGAAAAACA (SEQ ID NO: 2312) | 1 |
| 301 | sAD | TGCTCTTTTAGGATAGCTTGAAGTAATTTCGATTTCCCCATTCCTAATCCTTAAATAATG (SEQ ID NO: 2314) | 1 |
| 302 | mAD | TGCTCTTTTAGGATAGCTTGAAGTAATTTCGATTTCCCCATTCCTAATCCTTAAATAATG (SEQ ID NO: 2314) | 1 |
| 303 | sAD | CAGTATTAGGTTACTGATTTCTGATTTTTCGAATGATCTAAAAAAAAAAAAAGTTAGACC (SEQ ID NO: 2316) | 12 |
| 304 | mAD | CAGTATTAGGTTACTGATTTCTGATTTTTCGAATGATCTAAAAAAAAAAAAAGTTAGACC (SEQ ID NO: 2316) | 12 |
| 305 | sAD | GCAATTCATATAGTCTAAAAAATTTTAATCGAGGAAGATTAAGTGACCTGATAAAGTGGA (SEQ ID NO: 2318) | 13 |
| 306 | mAD | GCAATTCATATAGTCTAAAAAATTTTAATCGAGGAAGATTAAGTGACCTGATAAAGTGGA (SEQ ID NO: 2318) | 13 |
| 307 | mAD | TTTTTAAAGAAGGTTTGTATCATATTTCTCGAAGAGTGGCATGCTTTTCCCAAATGTCAC (SEQ ID NO: 2320) | 19 |
| 308 | sAD | TTTTTAAAGAAGGTTTGTATCATATTTCTCGAAGAGTGGCATGCTTTTCCCAAATGTCAC (SEQ ID NO: 2320) | 19 |
| 309 | sAD | AGATTTTTTTTTTTAAAATGATTTCAATCGAGAGAGTGTTTAAATCCAGAGATTTGTGA (SEQ ID NO: 2322) | 2 |
| 310 | mAD | AGATTTTTTTTTTTAAAATGATTTCAATCGAGAGAGTGTTTAAATCCAGAGATTTGTGA (SEQ ID NO: 2322) | 2 |
| 311 | sAD | TTGACTCTTTTGAACCTCTTGAGACTTGTCGAAGCAGTCTAATTTTAGGTTTAAAAGAAT (SEQ ID NO: 2324) | 22 |
| 312 | mAD | TTGACTCTTTTGAACCTCTTGAGACTTGTCGAAGCAGTCTAATTTTAGGTTTAAAAGAAT (SEQ ID NO: 2324) | 22 |
| 313 | sAD | ATATATGACCTAACCTATTAAAAAGAGATCGATTGATAATAAAATTTGTCATTTTCTCAG | 4 |

TABLE 3.c5-continued

| Loop Detected | Probe sequence 60 mer | Probe Location Chr |
|---|---|---|
| | (SEQ ID NO: 2326) | |
| 314 mAD | ATATATGACCTAACCTATTAAAAAGAGATCGATTGATAATAAAATTTGTCATTTTCTCAG (SEQ ID NO: 2326) | 4 |
| 315 sAD | ACTTAATTTAACATAATTATTAAATTGATCGACCTACCCATCTTTTAAAATCTTTCTGTC (SEQ ID NO: 2328) | 5 |
| 316 mAD | ACTTAATTTAACATAATTATTAAATTGATCGACCTACCCATCTTTTAAAATCTTTCTGTC (SEQ ID NO: 2328) | 5 |
| 317 sAD | TTTTGGTTGAAATGTATACCAACAATTTTCGAACAGAATACATAGAAAGTACCAAGAGAA (SEQ ID NO: 2330) | 6 |
| 318 mAD | TTTTGGTTGAAATGTATACCAACAATTTTCGAACAGAATACATAGAAAGTACCAAGAGAA (SEQ ID NO: 2330) | 6 |
| 319 mAD | TTTAAAATGCTTTAAAATTGTTTAAATATCGACTCTAGGATGCCATACCATAAGCATCTT (SEQ ID NO: 2332) | 8 |
| 320 sAD | TTTAAAATGCTTTAAAATTGTTTAAATATCGACTCTAGGATGCCATACCATAAGCATCTT (SEQ ID NO: 2332) | 8 |
| 321 sAD | CAGTAATCCTAGAAAGACAACTGATACATCGAATTCCAACTCTCATCACAGTAGCAGCAC (SEQ ID NO: 2334) | 8 |
| 322 mAD | CAGTAATCCTAGAAAGACAACTGATACATCGAATTCCAACTCTCATCACAGTAGCAGCAC (SEQ ID NO: 2334) | 8 |
| 323 sAD | TTTCAGAGAAGTATTAACTACAGACATTTCGAAGACGTTATCCCTGTAAATTACCTCTAC (SEQ ID NO: 2336) | 2 |
| 324 mAD | TTTCAGAGAAGTATTAACTACAGACATTTCGAAGACGTTATCCCTGTAAATTACCTCTAC (SEQ ID NO: 2336) | 2 |
| 325 sAD | GTTAGAAACTGTTTTTCACAATTAAGTTTCGAATATTACTTTTATTCCCCCCACCAAACT (SEQ ID NO: 2338) | 1 |
| 326 mAD | GTTAGAAACTGTTTTTCACAATTAAGTTTCGAATATTACTTTTATTCCCCCCACCAAACT (SEQ ID NO: 2338) | 1 |
| 327 sAD | CTCCTTCAACCTGGTGGATCCACCAGTTTCGACATCTTTAACCAATTACATCTGTAAGAA (SEQ ID NO: 2340) | 12 |
| 328 mAD | CTCCTTCAACCTGGTGGATCCACCAGTTTCGACATCTTTAACCAATTACATCTGTAAGAA (SEQ ID NO: 2340) | 12 |
| 329 mAD | CAGCTTGTACTCAGATATCTTCCTTTAATCGATTGGTGAGATTTTTAAGTTCAAAATGTA (SEQ ID NO: 2342) | 13 |
| 330 sAD | CAGCTTGTACTCAGATATCTTCCTTTAATCGATTGGTGAGATTTTTAAGTTCAAAATGTA (SEQ ID NO: 2342) | 13 |

TABLE 3.c6

| | Probe Location | | | | 4 kb Sequence Location | | | |
|---|---|---|---|---|---|---|---|---|
| | Start1 | End1 | Start2 | End2 | Chr | Start1 | End1 | Start2 | End2 |
| 221 | 62565038 | 62565069 | 62592928 | 62592959 | 16 | 62561068 | 62565069 | 62588958 | 62592959 |
| 222 | 62565038 | 62565069 | 62592928 | 62592959 | 16 | 62561068 | 62565069 | 62588958 | 62592959 |
| 223 | 47506510 | 47506541 | 47549933 | 47549964 | 2 | 47506510 | 47510511 | 47549933 | 47553934 |
| 224 | 47506510 | 47506541 | 47549933 | 47549964 | 2 | 47506510 | 47510511 | 47549933 | 47553934 |
| 225 | 19848139 | 19848170 | 19898126 | 19898157 | 20 | 19844169 | 19848170 | 19898126 | 19902127 |
| 226 | 19848139 | 19848170 | 19898126 | 19898157 | 20 | 19844169 | 19848170 | 19898126 | 19902127 |
| 227 | 107658435 | 107658466 | 107699795 | 107699826 | 3 | 107654465 | 107658466 | 107695825 | 107699826 |
| 228 | 107658435 | 107658466 | 107699795 | 107699826 | 3 | 107654465 | 107658466 | 107695825 | 107699826 |
| 229 | 39211112 | 39211143 | 39287559 | 39287590 | 3 | 39211112 | 39215113 | 39283589 | 39287590 |
| 230 | 39211112 | 39211143 | 39287559 | 39287590 | 3 | 39211112 | 39215113 | 39283589 | 39287590 |
| 231 | 154259015 | 154259046 | 154312039 | 154312070 | 6 | 154255045 | 154259046 | 154308069 | 154312070 |
| 232 | 154259015 | 154259046 | 154312039 | 154312070 | 6 | 154255045 | 154259046 | 154308069 | 154312070 |
| 233 | 40454949 | 40454980 | 40488042 | 40488073 | 6 | 40454949 | 40458950 | 40488042 | 40492043 |
| 234 | 40454949 | 40454980 | 40488042 | 40488073 | 6 | 40454949 | 40458950 | 40488042 | 40492043 |

TABLE 3.c6-continued

| | Probe Location | | | | | 4 kb Sequence Location | | | |
|---|---|---|---|---|---|---|---|---|---|
| | Start1 | End1 | Start2 | End2 | Chr | Start1 | End1 | Start2 | End2 |
| 235 | 221097555 | 221097586 | 221141648 | 221141679 | 1 | 221097555 | 221101556 | 221137678 | 221141679 |
| 236 | 221097555 | 221097586 | 221141648 | 221141679 | 1 | 221097555 | 221101556 | 221137678 | 221141679 |
| 237 | 106699511 | 106699542 | 106728195 | 106728226 | 11 | 106695541 | 106699542 | 106724225 | 106728226 |
| 238 | 106699511 | 106699542 | 106728195 | 106728226 | 11 | 106695541 | 106699542 | 106724225 | 106728226 |
| 239 | 60855000 | 60855031 | 60904843 | 60904874 | 13 | 60851030 | 60855031 | 60904843 | 60908844 |
| 240 | 60855000 | 60855031 | 60904843 | 60904874 | 13 | 60851030 | 60855031 | 60904843 | 60908844 |
| 241 | 38203591 | 38203622 | 38243208 | 38243239 | 14 | 38203591 | 38207592 | 38239238 | 38243239 |
| 242 | 38203591 | 38203622 | 38243208 | 38243239 | 14 | 38203591 | 38207592 | 38239238 | 38243239 |
| 243 | 15155840 | 15155871 | 15194993 | 15195024 | 16 | 15155840 | 15159841 | 15191023 | 15195024 |
| 244 | 15155840 | 15155871 | 15194993 | 15195024 | 16 | 15155840 | 15159841 | 15191023 | 15195024 |
| 245 | 117366498 | 117366529 | 117423152 | 117423183 | 7 | 117362528 | 117366529 | 117423152 | 117427153 |
| 246 | 117366498 | 117366529 | 117423152 | 117423183 | 7 | 117362528 | 117366529 | 117423152 | 117427153 |
| 247 | 116579148 | 116579179 | 116593950 | 116593981 | 1 | 116579148 | 116583149 | 116593950 | 116597951 |
| 248 | 116579148 | 116579179 | 116593950 | 116593981 | 1 | 116579148 | 116583149 | 116593950 | 116597951 |
| 249 | 138027490 | 138027521 | 138075531 | 138075562 | 2 | 138023520 | 138027521 | 138071561 | 138075562 |
| 250 | 138027490 | 138027521 | 138075531 | 138075562 | 2 | 138023520 | 138027521 | 138071561 | 138075562 |
| 251 | 46574127 | 46574158 | 46643075 | 46643106 | 20 | 46570157 | 46574158 | 46643075 | 46647076 |
| 252 | 46574127 | 46574158 | 46643075 | 46643106 | 20 | 46570157 | 46574158 | 46643075 | 46647076 |
| 253 | 127434266 | 127434297 | 127460011 | 127460042 | 5 | 127434266 | 127438267 | 127460011 | 127464012 |
| 254 | 127434266 | 127434297 | 127460011 | 127460042 | 5 | 127434266 | 127438267 | 127460011 | 127464012 |
| 255 | 102956535 | 102956566 | 102980783 | 102980814 | 2 | 102952565 | 102956566 | 102980783 | 102984784 |
| 256 | 102956535 | 102956566 | 102980783 | 102980814 | 2 | 102952565 | 102956566 | 102980783 | 102984784 |
| 257 | 92986182 | 92986213 | 93038794 | 93038825 | 7 | 92986182 | 92990183 | 93038794 | 93042795 |
| 258 | 92986182 | 92986213 | 93038794 | 93038825 | 7 | 92986182 | 92990183 | 93038794 | 93042795 |
| 259 | 84068704 | 84068735 | 84135705 | 84135736 | 11 | 84064734 | 84068735 | 84131735 | 84135736 |
| 260 | 84068704 | 84068735 | 84135705 | 84135736 | 11 | 84064734 | 84068735 | 84131735 | 84135736 |
| 261 | 35676542 | 35676573 | 35751811 | 35751842 | 1 | 35676542 | 35680543 | 35747841 | 35751842 |
| 262 | 35676542 | 35676573 | 35751811 | 35751842 | 1 | 35676542 | 35680543 | 35747841 | 35751842 |
| 263 | 59152323 | 59152354 | 59205229 | 59205260 | 1 | 59152323 | 59156324 | 59201259 | 59205260 |
| 264 | 59152323 | 59152354 | 59205229 | 59205260 | 1 | 59152323 | 59156324 | 59201259 | 59205260 |
| 265 | 82866083 | 82866114 | 82889344 | 82889375 | 10 | 82866083 | 82870084 | 82889344 | 82893345 |
| 266 | 82866083 | 82866114 | 82889344 | 82889375 | 10 | 82866083 | 82870084 | 82889344 | 82893345 |
| 267 | 42500999 | 42501030 | 42536264 | 42536295 | 15 | 42497029 | 42501030 | 42536264 | 42540265 |
| 268 | 42500999 | 42501030 | 42536264 | 42536295 | 15 | 42497029 | 42501030 | 42536264 | 42540265 |
| 269 | 209524455 | 209524486 | 209561479 | 209561510 | 2 | 209520485 | 209524486 | 209557509 | 209561510 |
| 270 | 209524455 | 209524486 | 209561479 | 209561510 | 2 | 209520485 | 209524486 | 209557509 | 209561510 |
| 271 | 46534139 | 46534170 | 46569163 | 46569194 | 2 | 46530169 | 46534170 | 46569163 | 46573164 |
| 272 | 46534139 | 46534170 | 46569163 | 46569194 | 2 | 46530169 | 46534170 | 46569163 | 46573164 |
| 273 | 37862801 | 37862832 | 37889307 | 37889338 | 4 | 37858831 | 37862832 | 37889307 | 37893308 |
| 274 | 37862801 | 37862832 | 37889307 | 37889338 | 4 | 37858831 | 37862832 | 37889307 | 37893308 |
| 275 | 124814333 | 124814364 | 124884100 | 124884131 | 5 | 124810363 | 124814364 | 124880130 | 124884131 |
| 276 | 124814333 | 124814364 | 124884100 | 124884131 | 5 | 124810363 | 124814364 | 124880130 | 124884131 |
| 277 | 74305244 | 74305275 | 74329889 | 74329920 | 5 | 74305244 | 74309245 | 74325919 | 74329920 |
| 278 | 74305244 | 74305275 | 74329889 | 74329920 | 5 | 74305244 | 74309245 | 74325919 | 74329920 |
| 279 | 137345960 | 137345991 | 137362789 | 137362820 | 6 | 137345960 | 137349961 | 137362789 | 137366790 |
| 280 | 137345960 | 137345991 | 137362789 | 137362820 | 6 | 137345960 | 137349961 | 137362789 | 137366790 |
| 281 | 67246259 | 67246290 | 67291641 | 67291672 | 3 | 67242289 | 67246290 | 67291641 | 67295642 |
| 282 | 67246259 | 67246290 | 67291641 | 67291672 | 3 | 67242289 | 67246290 | 67291641 | 67295642 |
| 283 | 192746085 | 192746116 | 192807100 | 192807131 | 3 | 192742115 | 192746116 | 192807100 | 192811101 |
| 284 | 192746085 | 192746116 | 192807100 | 192807131 | 3 | 192742115 | 192746116 | 192807100 | 192811101 |
| 285 | 59264971 | 59265002 | 59348306 | 59348337 | 4 | 59264971 | 59268972 | 59344336 | 59348337 |
| 286 | 59264971 | 59265002 | 59348306 | 59348337 | 4 | 59264971 | 59268972 | 59344336 | 59348337 |
| 287 | 39309663 | 39309694 | 39333851 | 39333882 | X | 39305693 | 39309694 | 39329881 | 39333882 |
| 288 | 39309663 | 39309694 | 39333851 | 39333882 | X | 39305693 | 39309694 | 39329881 | 39333882 |
| 289 | 209692609 | 209692640 | 209738615 | 209738646 | 2 | 209688639 | 209692640 | 209734645 | 209738646 |
| 290 | 209692609 | 209692640 | 209738615 | 209738646 | 2 | 209688639 | 209692640 | 209734645 | 209738646 |
| 291 | 58564115 | 58564146 | 58585950 | 58585981 | 15 | 58560145 | 58564146 | 58581980 | 58585981 |
| 292 | 58564115 | 58564146 | 58585950 | 58585981 | 15 | 58560145 | 58564146 | 58581980 | 58585981 |
| 293 | 97124956 | 97124987 | 97199512 | 97199543 | 13 | 97124956 | 97128957 | 97195542 | 97199543 |
| 294 | 97124956 | 97124987 | 97199512 | 97199543 | 13 | 97124956 | 97128957 | 97195542 | 97199543 |
| 295 | 159354550 | 159354581 | 159380368 | 159380399 | 5 | 159350580 | 159354581 | 159376398 | 159380399 |
| 296 | 159354550 | 159354581 | 159380368 | 159380399 | 5 | 159350580 | 159354581 | 159376398 | 159380399 |
| 297 | 93011591 | 93011622 | 93038763 | 93038794 | 7 | 93011591 | 93015592 | 93034793 | 93038794 |
| 298 | 93011591 | 93011622 | 93038763 | 93038794 | 7 | 93011591 | 93015592 | 93034793 | 93038794 |
| 299 | 69089823 | 69089854 | 69164723 | 69164754 | 1 | 69089823 | 69093824 | 69164723 | 69168724 |
| 300 | 69089823 | 69089854 | 69164723 | 69164754 | 1 | 69089823 | 69093824 | 69164723 | 69168724 |
| 301 | 76003880 | 76003911 | 76086306 | 76086337 | 1 | 75999910 | 76003911 | 76082336 | 76086337 |
| 302 | 76003880 | 76003911 | 76086306 | 76086337 | 1 | 75999910 | 76003911 | 76082336 | 76086337 |
| 303 | 75136236 | 75136267 | 75166435 | 75166466 | 12 | 75136236 | 75140237 | 75166435 | 75170436 |
| 304 | 75136236 | 75136267 | 75166435 | 75166466 | 12 | 75136236 | 75140237 | 75166435 | 75170436 |
| 305 | 33822756 | 33822787 | 33873349 | 33873380 | 13 | 33822756 | 33826757 | 33873349 | 33877350 |
| 306 | 33822756 | 33822787 | 33873349 | 33873380 | 13 | 33822756 | 33826757 | 33873349 | 33877350 |
| 307 | 46481483 | 46481514 | 46545017 | 46545048 | 19 | 46477513 | 46481514 | 46541047 | 46545048 |
| 308 | 46481483 | 46481514 | 46545017 | 46545048 | 19 | 46477513 | 46481514 | 46541047 | 46545048 |
| 309 | 5850709 | 5850740 | 5932311 | 5932342 | 2 | 5850709 | 5854710 | 5928341 | 5932342 |
| 310 | 5850709 | 5850740 | 5932311 | 5932342 | 2 | 5850709 | 5854710 | 5928341 | 5932342 |

TABLE 3.c6-continued

| | Probe Location | | | | 4 kb Sequence Location | | | |
|---|---|---|---|---|---|---|---|---|
| | Start1 | End1 | Start2 | End2 | Chr | Start1 | End1 | Start2 | End2 |
| 311 | 25666349 | 25666380 | 25695448 | 25695479 | 22 | 25662379 | 25666380 | 25691478 | 25695479 |
| 312 | 25666349 | 25666380 | 25695448 | 25695479 | 22 | 25662379 | 25666380 | 25691478 | 25695479 |
| 313 | 125340607 | 125340638 | 125357325 | 125357356 | 4 | 125340607 | 125344608 | 125357325 | 125361326 |
| 314 | 125340607 | 125340638 | 125357325 | 125357356 | 4 | 125340607 | 125344608 | 125357325 | 125361326 |
| 315 | 74294290 | 74294321 | 74391779 | 74391810 | 5 | 74294290 | 74298291 | 74387809 | 74391810 |
| 316 | 74294290 | 74294321 | 74391779 | 74391810 | 5 | 74294290 | 74298291 | 74387809 | 74391810 |
| 317 | 486508 | 486539 | 555690 | 555721 | 6 | 482538 | 486539 | 555690 | 559691 |
| 318 | 486508 | 486539 | 555690 | 555721 | 6 | 482538 | 486539 | 555690 | 559691 |
| 319 | 10103712 | 10103743 | 10177377 | 10177408 | 8 | 10099742 | 10103743 | 10173407 | 10177408 |
| 320 | 10103712 | 10103743 | 10177377 | 10177408 | 8 | 10099742 | 10103743 | 10173407 | 10177408 |
| 321 | 21022651 | 21022682 | 21054445 | 21054476 | 8 | 21022651 | 21026652 | 21054445 | 21058446 |
| 322 | 21022651 | 21022682 | 21054445 | 21054476 | 8 | 21022651 | 21026652 | 21054445 | 21058446 |
| 323 | 172804803 | 172804834 | 172831811 | 172831842 | 2 | 172800833 | 172804834 | 172831811 | 172835812 |
| 324 | 172804803 | 172804834 | 172831811 | 172831842 | 2 | 172800833 | 172804834 | 172831811 | 172835812 |
| 325 | 66141924 | 66141955 | 66168785 | 66168816 | 1 | 66141924 | 66145925 | 66164815 | 66168816 |
| 326 | 66141924 | 66141955 | 66168785 | 66168816 | 1 | 66141924 | 66145925 | 66164815 | 66168816 |
| 327 | 96219857 | 96219888 | 96237099 | 96237130 | 12 | 96219857 | 96223858 | 96237099 | 96241100 |
| 328 | 96219857 | 96219888 | 96237099 | 96237130 | 12 | 96219857 | 96223858 | 96237099 | 96241100 |
| 329 | 97124956 | 97124987 | 97147277 | 97147308 | 13 | 97124956 | 97128957 | 97147277 | 97151278 |
| 330 | 97124956 | 97124987 | 97147277 | 97147308 | 13 | 97124956 | 97128957 | 97147277 | 97151278 |

TABLE 3.c7

| | Probe | PCR-Primer1_ID | PCR_Primer1 |
|---|---|---|---|
| 221 | ORF15_16_62560699_62565069_62586208_62592959_FF | OBD159_1801 | GTTAGTATGTATTTTCTGTGGATA (SEQ ID NO: 2344) |
| 222 | ORF15_16_62560699_62565069_62586208_62592959_FF | OBD159_1801 | GTTAGTATGTATTTTCTGTGGATA (SEQ ID NO: 2344) |
| 223 | ORF15_2_47506510_47507935_47549933_47552565_RR | OBD159_1805 | GAAGCCTGGATTGGAAGCAGATTTG C (SEQ ID NO: 2346) |
| 224 | ORF15_2_47506510_47507935_47549933_47552565_RR | OBD159_1805 | GAAGCCTGGATTGGAAGCAGATTTG C (SEQ ID NO: 2346) |
| 225 | ORF15_20_19844341_19848170_19898126_19900554_FR | OBD159_1809 | GGGACATTGAGGTGTTGGTGGCA (SEQ ID NO: 2348) |
| 226 | ORF15_20_19844341_19848170_19898126_19900554_FR | OBD159_1809 | GGGACATTGAGGTGTTGGTGGCA (SEQ ID NO: 2348) |
| 227 | ORF15_3_107655921_107658466_107697731_107699826_FF | OBD159_1813 | TCCCTCGGAGCATAGAACTCATCTTC (SEQ ID NO: 2350) |
| 228 | ORF15_3_107655921_107658466_107697731_107699826_FF | OBD159_1813 | TCCCTCGGAGCATAGAACTCATCTTC (SEQ ID NO: 2350) |
| 229 | ORF15_3_39211112_39215294_39286446_39287590_RF | OBD159_1817 | AGTGTTTGGTGTCCAGCAAGCAGTGC (SEQ ID NO: 2352) |
| 230 | ORF15_3_39211112_39215294_39286446_39287590_RF | OBD159_1817 | AGTGTTTGGTGTCCAGCAAGCAGTGC (SEQ ID NO: 2352) |
| 231 | ORF15_6_154255952_154259046_154307704_154312070_FF | OBD159_1821 | ATGATGCCTTCCTATGTGCCTGGC (SEQ ID NO: 2354) |
| 232 | ORF15_6_154255952_154259046_154307704_154312070_FF | OBD159_1821 | ATGATGCCTTCCTATGTGCCTGGC (SEQ ID NO: 2354) |
| 233 | ORF15_6_40454949_40456428_40488042_40490875_RR | OBD159_1825 | GAGGAAGGGAAACAGTCAAGAGGTA T (SEQ ID NO: 2356) |
| 234 | ORF15_6_40454949_40456428_40488042_40490875_RR | OBD159_1825 | GAGGAAGGGAAACAGTCAAGAGGTA T (SEQ ID NO: 2356) |
| 235 | ORF150_1_221097555_221099745_221139551_221141679_RF | OBD159_1829 | AGAGGTTTAGAGTTTGGAACATTTGC (SEQ ID NO: 2358) |
| 236 | ORF150_1_221097555_221099745_221139551_221141679_RF | OBD159_1829 | AGAGGTTTAGAGTTTGGAACATTTGC (SEQ ID NO: 2358) |

TABLE 3.c7-continued

| | Probe | PCR-Primer1_ID | PCR_Primer1 |
|---|---|---|---|
| 237 | ORF151_11_106693665_106699542_106725393_106728226_FF | OBD159_1833 | GCAGAGTTGCCAATCACAGTATTTAT (SEQ ID NO: 2360) |
| 238 | ORF151_11_106693665_106699542_106725393_106728226_FF | OBD159_1833 | GCAGAGTTGCCAATCACAGTATTTAT (SEQ ID NO: 2360) |
| 239 | ORF152_13_60846170_60855031_60904843_60913572_FR | OBD159_1837 | CAGAGCAAATGAGTCAACTGAAAA (SEQ ID NO: 2362) |
| 240 | ORF152_13_60846170_60855031_60904843_60913572_FR | OBD159_1837 | CAGAGCAAATGAGTCAACTGAAAA (SEQ ID NO: 2362) |
| 241 | ORF154_14_38203591_38207960_38231669_38243239_RF | OBD159_1841 | GAAGGTAAATCTCATAGCAGGCTGG G (SEQ ID NO: 2364) |
| 242 | ORF154_14_38203591_38207960_38231669_38243239_RF | OBD159_1841 | GAAGGTAAATCTCATAGCAGGCTGG G (SEQ ID NO: 2364) |
| 243 | ORF155_16_15155840_15159398_15192529_15195024_RF | OBD159_1845 | TGTGAAATAATCAGTCTTGGAAAT (SEQ ID NO: 2366) |
| 244 | ORF155_16_15155840_15159398_15192529_15195024_RF | OBD159_1845 | TGTGAAATAATCAGTCTTGGAAAT (SEQ ID NO: 2366) |
| 245 | ORF155_7_117353457_117366529_117423152_117425489_FR | OBD159_1849 | ATTGCTTGAATCTGGAAGGCGGAG (SEQ ID NO: 2368) |
| 246 | ORF155_7_117353457_117366529_117423152_117425489_FR | OBD159_1849 | ATTGCTTGAATCTGGAAGGCGGAG (SEQ ID NO: 2368) |
| 247 | ORF156_1_116579148_116582139_116593950_116598324_RR | OBD159_1853 | GAGGGAGGATGTCACTGTTGGTTCCA (SEQ ID NO: 2370) |
| 248 | ORF156_1_116579148_116582139_116593950_116598324_RR | OBD159_1853 | GAGGGAGGATGTCACTGTTGGTTCCA (SEQ ID NO: 2370) |
| 249 | ORF156_2_138025661_138027521_138071201_138075562_FF | OBD159_1857 | TGCTGTGCTTGAAGGAAGGATGGTG T (SEQ ID NO: 2372) |
| 250 | ORF156_2_138025661_138027521_138071201_138075562_FF | OBD159_1857 | TGCTGTGCTTGAAGGAAGGATGGTG T (SEQ ID NO: 2372) |
| 251 | ORF156_20_46570710_46574158_46643075_46649811_FR | OBD159_1861 | CCTCCTTTTGCCTCCGATTCCTC (SEQ ID NO: 2374) |
| 252 | ORF156_20_46570710_46574158_46643075_46649811_FR | OBD159_1861 | CCTCCTTTTGCCTCCGATTCCTC (SEQ ID NO: 2374) |
| 253 | ORF156_5_127434266_127436041_127460011_127467027_RR | OBD159_1865 | CTTGGCATAAAGCAGGGCTCCAGGA A (SEQ ID NO: 2376) |
| 254 | ORF156_5_127434266_127436041_127460011_127467027_RR | OBD159_1865 | CTTGGCATAAAGCAGGGCTCCAGGA A (SEQ ID NO: 2376) |
| 255 | ORF158_2_102946170_102956566_102980783_102983000_FR | OBD159_1869 | CTATTTGCTTCCATCTCTTCTTCAAG (SEQ ID NO: 2108) |
| 256 | ORF158_2_102946170_102956566_102980783_102983000_FR | OBD159_1869 | CTATTTGCTTCCATCTCTTCTTCAAG (SEQ ID NO: 2108) |
| 257 | ORF158_7_92986182_92992000_93038794_93043170_RR | OBD159_1873 | CTAACACAATGGTAGACACATAGCAA (SEQ ID NO: 2380) |
| 258 | ORF158_7_92986182_92992000_93038794_93043170_RR | OBD159_1873 | CTAACACAATGGTAGACACATAGCAA (SEQ ID NO: 2380) |
| 259 | ORF159_11_84067130_84068735_84133096_84135736_FF | OBD159_1877 | ATGGAGTTCCCAGACTTAGCAAATAA (SEQ ID NO: 2382) |
| 260 | ORF159_11_84067130_84068735_84133096_84135736_FF | OBD159_1877 | ATGGAGTTCCCAGACTTAGCAAATAA (SEQ ID NO: 2382) |
| 261 | ORF16_1_35676542_35678104_35750293_35751842_RF | OBD159_1881 | GAGAAAAGGTGGGTAGGGAGTAGA GC (SEQ ID NO: 2384) |
| 262 | ORF16_1_35676542_35678104_35750293_35751842_RF | OBD159_1881 | GAGAAAAGGTGGGTAGGGAGTAGA |

TABLE 3.c7-continued

| | Probe | PCR-Primer1_ID | PCR_Primer1 |
|---|---|---|---|
| | | | GC (SEQ ID NO: 2384) |
| 263 | ORF16_1_59152323_59153557_59201894_59205260_RF | OBD159_1885 | TAACTTACAGGTCCCACAGATTAGGA (SEQ ID NO: 2386) |
| 264 | ORF16_1_59152323_59153557_59201894_59205260_RF | OBD159_1885 | TAACTTACAGGTCCCACAGATTAGGA (SEQ ID NO: 2386) |
| 265 | ORF16_10_82866083_82869829_82889344_82893485_RR | OBD159_1889 | CTAAATCCTGAGTGTCTTTCCATCCA (SEQ ID NO: 2388) |
| 266 | ORF16_10_82866083_82869829_82889344_82893485_RR | OBD159_1889 | CTAAATCCTGAGTGTCTTTCCATCCA (SEQ ID NO: 2388) |
| 267 | ORF16_15_42499291_42501030_42536264_42540825_FR | OBD159_1893 | GGAAGTGGATTATGGAGCCAGGAAA C (SEQ ID NO: 2390) |
| 268 | ORF16_15_42499291_42501030_42536264_42540825_FR | OBD159_1893 | GGAAGTGGATTATGGAGCCAGGAAA C (SEQ ID NO: 2390) |
| 269 | ORF16_2_209522065_209524486_209555031_209561510_FF | OBD159_1897 | CACACATAATCCAGAGTCAGGGAGA G (SEQ ID NO: 2392) |
| 270 | ORF16_2_209522065_209524486_209555031_209561510_FF | OBD159_1897 | CACACATAATCCAGAGTCAGGGAGA G (SEQ ID NO: 2392) |
| 271 | ORF16_2_46531602_46534170_46569163_46570628_FR | OBD159_1901 | TTTCTCCTACTTTGGATTTGTTGAGC (SEQ ID NO: 2394) |
| 272 | ORF16_2_46531602_46534170_46569163_46570628_FR | OBD159_1901 | TTTCTCCTACTTTGGATTTGTTGAGC (SEQ ID NO: 2394) |
| 273 | ORF16_4_37859966_37862832_37889307_37892348_FR | OBD159_1905 | CTTACAGCCTTCCAAAATAACTCCAG (SEQ ID NO: 950) |
| 274 | ORF16_4_37859966_37862832_37889307_37892348_FR | OBD159_1905 | CTTACAGCCTTCCAAAATAACTCCAG (SEQ ID NO: 950) |
| 275 | ORF16_5_124808480_124814364_124880024_124884131_FF | OBD159_1909 | TAGTTAGTTACCCATCTGTTTCTA (SEQ ID NO: 2398) |
| 276 | ORF16_5_124808480_124814364_124880024_124884131_FF | OBD159_1909 | TAGTTAGTTACCCATCTGTTTCTA (SEQ ID NO: 2398) |
| 277 | ORF16_5_74305244_74313564_74325511_74329920_RF | OBD159_1913 | CCACTCAGCCTCACAGAGCCTCA (SEQ ID NO: 2400) |
| 278 | ORF16_5_74305244_74313564_74325511_74329920_RF | OBD159_1913 | CCACTCAGCCTCACAGAGCCTCA (SEQ ID NO: 2400) |
| 279 | ORF16_6_137345960_137347521_137362789_137365756_RR | OBD159_1917 | CCTTTATCTCAAACTCCTCCAGTAGG (SEQ ID NO: 2402) |
| 280 | ORF16_6_137345960_137347521_137362789_137365756_RR | OBD159_1917 | CCTTTATCTCAAACTCCTCCAGTAGG (SEQ ID NO: 2402) |
| 281 | ORF160_3_67234045_67246290_67291641_67297587_FR | OBD159_1921 | CTGAACCTGTTTGTAAGTTGAGGGTG (SEQ ID NO: 2404) |
| 282 | ORF160_3_67234045_67246290_67291641_67297587_FR | OBD159_1921 | CTGAACCTGTTTGTAAGTTGAGGGTG (SEQ ID NO: 2404) |
| 283 | ORF161_3_192744752_192746116_192807100_192810430_FR | OBD159_1925 | CTATGCTCAAGAGAACTAAAGTAGGA (SEQ ID NO: 2406) |
| 284 | ORF161_3_192744752_192746116_192807100_192810430_FR | OBD159_1925 | CTATGCTCAAGAGAACTAAAGTAGGA (SEQ ID NO: 2406) |
| 285 | ORF161_4_59264971_59267015_59339329_59348337_RF | OBD159_1929 | CAAGATACCAGTGTTAGGTTGTGAAA (SEQ ID NO: 2408) |
| 286 | ORF161_4_59264971_59267015_59339329_59348337_RF | OBD159_1929 | CAAGATACCAGTGTTAGGTTGTGAAA (SEQ ID NO: 2408) |
| 287 | ORF162_X_39303922_39309694_39331263_39333882_FF | OBD159_1933 | GTCTGGGAGGCATTTGGAGCATC (SEQ ID NO: 2410) |

TABLE 3.c7-continued

| | Probe | PCR-Primer1_ID | PCR_Primer1 |
|---|---|---|---|
| 288 | ORF162_X_39303922_39309694_39331263_39333882_FF | OBD159_1933 | GTCTGGGAGGCATTTGGAGCATC (SEQ ID NO: 2410) |
| 289 | ORF163_2_209684451_209692640_209735707_209738646_FF | OBD159_1937 | GCTTATTTCCTGAACGCACTTGCCTA (SEQ ID NO: 2412) |
| 290 | ORF163_2_209684451_209692640_209735707_209738646_FF | OBD159_1937 | GCTTATTTCCTGAACGCACTTGCCTA (SEQ ID NO: 2412) |
| 291 | ORF164_15_58557606_58564146_58584664_58585981_FF | OBD159_1941 | GCCAGTCCAAGGTGCTGTGGTAG (SEQ ID NO: 2414) |
| 292 | ORF164_15_58557606_58564146_58584664_58585981_FF | OBD159_1941 | GCCAGTCCAAGGTGCTGTGGTAG (SEQ ID NO: 2414) |
| 293 | ORF165_13_97124956_97128666_97195242_97199543_RF | OBD159_1945 | ATCTATGCCTGCCACAAAGTAGGG (SEQ ID NO: 2416) |
| 294 | ORF165_13_97124956_97128666_97195242_97199543_RF | OBD159_1945 | ATCTATGCCTGCCACAAAGTAGGG (SEQ ID NO: 2416) |
| 295 | ORF165_5_159344811_159354581_159378555_159380399_FF | OBD159_1949 | TGATGAGGTTGTAATGTTATTTCA (SEQ ID NO: 2418) |
| 296 | ORF165_5_159344811_159354581_159378555_159380399_FF | OBD159_1949 | TGATGAGGTTGTAATGTTATTTCA (SEQ ID NO: 2418) |
| 297 | ORF169_7_93011591_93016612_93036188_93038794_RF | OBD159_1953 | GAAGAATAATGAAACCTCCTGGAAG G (SEQ ID NO: 2420) |
| 298 | ORF169_7_93011591_93016612_93036188_93038794_RF | OBD159_1953 | GAAGAATAATGAAACCTCCTGGAAG G (SEQ ID NO: 2420) |
| 299 | ORF17_1_69089823_69102269_69164723_69166979_RR | OBD159_1957 | TAGTGCCTGAGGAGACATCTTACAGC (SEQ ID NO: 2422) |
| 300 | ORF17_1_69089823_69102269_69164723_69166979_RR | OBD159_1957 | TAGTGCCTGAGGAGACATCTTACAGC (SEQ ID NO: 2422) |
| 301 | ORF17_1_76000194_76003911_76083373_76086337_FF | OBD159_1961 | GGCAGAAGCAGAACTTGGCTCTTATT (SEQ ID NO: 2424) |
| 302 | ORF17_1_76000194_76003911_76083373_76086337_FF | OBD159_1961 | GGCAGAAGCAGAACTTGGCTCTTATT (SEQ ID NO: 2424) |
| 303 | ORF17_12_75136236_75139196_75166435_75186315_RR | OBD159_1965 | GGTGAGCGTAGTTGTTCATAATAGTC (SEQ ID NO: 2426) |
| 304 | ORF17_12_75136236_75139196_75166435_75186315_RR | OBD159_1965 | GGTGAGCGTAGTTGTTCATAATAGTC (SEQ ID NO: 2426) |
| 305 | ORF17_13_33822756_33828516_33873349_33876786_RR | OBD159_1969 | TCCAGGTATCTACTTTTCTTCTAT (SEQ ID NO: 1425) |
| 306 | ORF17_13_33822756_33828516_33873349_33876786_RR | OBD159_1969 | TCCAGGTATCTACTTTTCTTCTAT (SEQ ID NO: 1425) |
| 307 | ORF17_19_46479838_46481514_46541191_46545048_FF | OBD159_1973 | GGTCTGAACACAGTCTTGGCTGG (SEQ ID NO: 2430) |
| 308 | ORF17_19_46479838_46481514_46541191_46545048_FF | OBD159_1973 | GGTCTGAACACAGTCTTGGCTGG (SEQ ID NO: 2430) |
| 309 | ORF17_2_5850709_5859559_5924503_5932342_RF | OBD159_1977 | CCCAGGTCTCCAGGTCTCCTTAG (SEQ ID NO: 2432) |
| 310 | ORF17_2_5850709_5859559_5924503_5932342_RF | OBD159_1977 | CCCAGGTCTCCAGGTCTCCTTAG (SEQ ID NO: 2432) |
| 311 | ORF17_22_25661627_25666380_25694410_25695479_FF | OBD159_1981 | GCCTGTTGCGGTTCTTTCTGTTGAA (SEQ ID NO: 2434) |
| 312 | ORF17_22_25661627_25666380_25694410_25695479_FF | OBD159_1981 | GCCTGTTGCGGTTCTTTCTGTTGAA (SEQ ID NO: 2434) |
| 313 | ORF17_4_125340607_125343598_125357325_125363715_RR | OBD159_1985 | GAAACTGGAAAACTTTAGAGAAGAG C (SEQ ID NO: 2436) |

TABLE 3.c7-continued

| | Probe | PCR-Primer1_ID | PCR_Primer1 |
|---|---|---|---|
| 314 | ORF17_4_125340607_125343598_125357325_125363715_RR | OBD159_1985 | GAAACTGGAAAACTTTAGAGAAGAG C (SEQ ID NO: 2436) |
| 315 | ORF17_5_74294290_74298111_74386498_74391810_RF | OBD159_1989 | CTTGGCGATTTGTATGAGTAGGTTGC (SEQ ID NO: 2438) |
| 316 | ORF17_5_74294290_74298111_74386498_74391810_RF | OBD159_1989 | CTTGGCGATTTGTATGAGTAGGTTGC (SEQ ID NO: 2438) |
| 317 | ORF17_6_482421_486539_555690_558488_FR | OBD159_1993 | GGCAAAACAAATACTTCCTGGGCATT (SEQ ID NO: 2440) |
| 318 | ORF17_6_482421_486539_555690_558488_FR | OBD159_1993 | GGCAAAACAAATACTTCCTGGGCATT (SEQ ID NO: 2440) |
| 319 | ORF17_8_10100695_10103743_10175271_10177408_FF | OBD159_1997 | AGTGAGATAATGTGCCTGAAAGCAAT (SEQ ID NO: 532) |
| 320 | ORF17_8_10100695_10103743_10175271_10177408_FF | OBD159_1997 | AGTGAGATAATGTGCCTGAAAGCAAT (SEQ ID NO: 532) |
| 321 | ORF17_8_21022651_21025530_21054445_21056962_RR | OBD159_2001 | CGGGAGGTTTCTGTGAGAGGTGTTCT (SEQ ID NO: 2444) |
| 322 | ORF17_8_21022651_21025530_21054445_21056962_RR | OBD159_2001 | CGGGAGGTTTCTGTGAGAGGTGTTCT (SEQ ID NO: 2444) |
| 323 | ORF173_2_172799773_172804834_172831811_172834823_FR | OBD159_2005 | TCCCAAGGGCACCTGCTCACAAG (SEQ ID NO: 2446) |
| 324 | ORF173_2_172799773_172804834_172831811_172834823_FR | OBD159_2005 | TCCCAAGGGCACCTGCTCACAAG (SEQ ID NO: 2446) |
| 325 | ORF174_1_66141924_66143825_66164982_66168816_RF | OBD159_2009 | GGGAGAATGAGGAATGAGGACCG (SEQ ID NO: 2448) |
| 326 | ORF174_1_66141924_66143825_66164982_66168816_RF | OBD159_2009 | GGGAGAATGAGGAATGAGGACCG (SEQ ID NO: 2448) |
| 327 | ORF174_12_96219857_96223649_96237099_96241349_RR | OBD159_2013 | ATCATCAGAGGATTACTCAGAGGG (SEQ ID NO: 2450) |
| 328 | ORF174_12_96219857_96223649_96237099_96241349_RR | OBD159_2013 | ATCATCAGAGGATTACTCAGAGGG (SEQ ID NO: 2450) |
| 329 | ORF174_13_97124956_97128666_97147277_97152656_RR | OBD159_2017 | CTCTTTCTGAGGCTTTTGTTCATA (SEQ ID NO: 2452) |
| 330 | ORF174_13_97124956_97128666_97147277_97152656_RR | OBD159_2017 | CTCTTTCTGAGGCTTTTGTTCATA (SEQ ID NO: 2452) |

TABLE 3.c8

| | PCR-Primer2_ID | PCR_Primer2 | Marker | GLMNET |
|---|---|---|---|---|
| 221 | OBD159_1803 | GTATTTTGTTATCTTACCTAATGGA (SEQ ID NO: 2454) | OBD159_1801_1803 | 0.001962204 |
| 222 | OBD159_1803 | GTATTTTGTTATCTTACCTAATGGA (SEQ ID NO: 2455) | OBD159_1801_1803 | 0.001962204 |
| 223 | OBD159_1807 | CTATTGCTATGTCTTCAAGTTCAACC (SEQ ID NO: 2456) | OBD159_1805_1807 | 0.001626338 |
| 224 | OBD159_1807 | CTATTGCTATGTCTTCAAGTTCAACC (SEQ ID NO: 2457) | OBD159_1805_1807 | 0.001626338 |
| 225 | OBD159_1811 | GAAGTCCCCTGGCGAAGATGAGC (SEQ ID NO: 2458) | OBD159_1809_1811 | 0.000814341 |
| 226 | OBD159_1811 | GAAGTCCCCTGGCGAAGATGAGC (SEQ ID NO: 2459) | OBD159_1809_1811 | 0.000814341 |

TABLE 3.c8-continued

| | PCR-Primer2_ID | PCR_Primer2 | Marker | GLMNET |
|---|---|---|---|---|
| 227 | OBD159_1815 | GGCTCTGACATAACTCCACAAGGGTA (SEQ ID NO: 2460) | OBD159_1813_1815 | 0.001480022 |
| 228 | OBD159_1815 | GGCTCTGACATAACTCCACAAGGGTA (SEQ ID NO: 2461) | OBD159_1813_1815 | 0.001480022 |
| 229 | OBD159_1819 | GGTCGGATTCTGGCTACATTTTGAAG (SEQ ID NO: 2462) | OBD159_1817_1819 | 0.00207786 |
| 230 | OBD159_1819 | GGTCGGATTCTGGCTACATTTTGAAG (SEQ ID NO: 2463) | OBD159_1817_1819 | 0.00207786 |
| 231 | OBD159_1823 | GTGTGTAGTCAGTCAATGGGAAGGAA (SEQ ID NO: 2464) | OBD159_1821_1823 | 0.002644379 |
| 232 | OBD159_1823 | GTGTGTAGTCAGTCAATGGGAAGGAA (SEQ ID NO: 2465) | OBD159_1821_1823 | 0.002644379 |
| 233 | OBD159_1827 | GACCTGTTTCCCTCCCAAGAGCCTAT (SEQ ID NO: 2466) | OBD159_1825_1827 | 0.001541761 |
| 234 | OBD159_1827 | GACCTGTTTCCCTCCCAAGAGCCTAT (SEQ ID NO: 2467) | OBD159_1825_1827 | 0.001541761 |
| 235 | OBD159_1831 | CACTTTGTTGCCTGAGTTGCCTA (SEQ ID NO: 2468) | OBD159_1829_1831 | 0.000897371 |
| 236 | OBD159_1831 | CACTTTGTTGCCTGAGTTGCCTA (SEQ ID NO: 2469) | OBD159_1829_1831 | 0.000897371 |
| 237 | OBD159_1835 | CCAATGGCTCCCAACTTCCCACTAAT (SEQ ID NO: 2470) | OBD159_1833_1835 | 0.00142553 |
| 238 | OBD159_1835 | CCAATGGCTCCCAACTTCCCACTAAT (SEQ ID NO: 2471) | OBD159_1833_1835 | 0.00142553 |
| 239 | OBD159_1839 | CAAGTAACTCTTATTATTITGAGGT (SEQ ID NO: 2472) | OBD159_1837_1839 | 0.000674976 |
| 240 | OBD159_1839 | CAAGTAACTCTTATTATTITGAGGT (SEQ ID NO: 2473) | OBD159_1837_1839 | 0.000674976 |
| 241 | OBD159_1843 | CATAAAAGCAGAACAGGAGCACATTC (SEQ ID NO: 2474) | OBD159_1841_1843 | 0.000851875 |
| 242 | OBD159_1843 | CATAAAAGCAGAACAGGAGCACATTC (SEQ ID NO: 2475) | OBD159_1841_1843 | 0.000851875 |
| 243 | OBD159_1847 | CCAAAGTGCTGGGATTACAGGCAT (SEQ ID NO: 2476) | OBD159_1845_1847 | 0.001606372 |
| 244 | OBD159_1847 | CCAAAGTGCTGGGATTACAGGCAT (SEQ ID NO: 2477) | OBD159_1845_1847 | 0.001606372 |
| 245 | OBD159_1851 | TTTTCTCCCAGTGATTATTATGTA (SEQ ID NO: 2478) | OBD159_1849_1851 | 0.000653215 |
| 246 | OBD159_1851 | TTTTCTCCCAGTGATTATTATGTA (SEQ ID NO: 2479) | OBD159_1849_1851 | 0.000653215 |
| 247 | OBD159_1855 | AATCCTCTCTTGACTGACCTGGCATA (SEQ ID NO: 2480) | OBD159_1853_1855 | 0.000349443 |
| 248 | OBD159_1855 | AATCCTCTCTTGACTGACCTGGCATA (SEQ ID NO: 2481 | OBD159_1853_1855 | 0.000349443 |
| 249 | OBD159_1859 | TAGGCTGTTTCAGTGACCCAGAA (SEQ ID NO: 2482) | OBD159_1857_1859 | 0.000559234 |
| 250 | OBD159_1859 | TAGGCTGTTTCAGTGACCCAGAA (SEQ ID NO: 2483) | OBD159_1857_1859 | 0.000559234 |
| 251 | OBD159_1863 | TATCTTTGGTGCCAGCCCCGTGC (SEQ ID NO: 2484) | OBD159_1861_1863 | 0.000600787 |
| 252 | OBD159_1863 | TATCTTTGGTGCCAGCCCCGTGC (SEQ ID NO: 2485) | OBD159_1861_1863 | 0.000600787 |

TABLE 3.c8-continued

| | PCR-Primer2_ID | PCR_Primer2 | Marker | GLMNET |
|---|---|---|---|---|
| 253 | OBD159_1867 | AACTCCTTTACTGCTTTGACCACCAT (SEQ ID NO: 2486) | OBD159_1865_1867 | 0.001137489 |
| 254 | OBD159_1867 | AACTCCTTTACTGCTTTGACCACCAT (SEQ ID NO: 2487) | OBD159_1865_1867 | 0.001137489 |
| 255 | OBD159_1871 | TGGCTATGAAGGGCAGGAGAGGAATA (SEQ ID NO: 2488) | OBD159_1869_1871 | 0.001002895 |
| 256 | OBD159_1871 | TGGCTATGAAGGGCAGGAGAGGAATA (SEQ ID NO: 2489) | OBD159_1869_1871 | 0.001002895 |
| 257 | OBD159_1875 | CCTGTTGAATGACTAACTGGATGAGA (SEQ ID NO: 2490) | OBD159_1873_1875 | 0.001335563 |
| 258 | OBD159_1875 | CCTGTTGAATGACTAACTGGATGAGA (SEQ ID NO: 2491) | OBD159_1873_1875 | 0.001335563 |
| 259 | OBD159_1879 | GTAGTCAGGCAAAGAGAGTAGGGCAT (SEQ ID NO: 2492) | OBD159_1877_1879 | 0.000872807 |
| 260 | OBD159_1879 | GTAGTCAGGCAAAGAGAGTAGGGCAT (SEQ ID NO: 2493) | OBD159_1877_1879 | 0.000872807 |
| 261 | OBD159_1883 | CCCTGTATTCTTAGGCACCAAGTCTT (SEQ ID NO: 2494) | OBD159_1881_1883 | 0.002374347 |
| 262 | OBD159_1883 | CCCTGTATTCTTAGGCACCAAGTCTT (SEQ ID NO: 2495) | OBD159_1881_1883 | 0.002374347 |
| 263 | OBD159_1887 | CTTACTTTGCTCAATCAGTTCCTCTG (SEQ ID NO: 2496) | OBD159_1885_1887 | 0.001221285 |
| 264 | OBD159_1887 | CTTACTTTGCTCAATCAGTTCCTCTG (SEQ ID NO: 2497) | OBD159_1885_1887 | 0.001221285 |
| 265 | OBD159_1891 | CCCTCTCCAAACCTCCTTCTCTCAAG (SEQ ID NO: 2498) | OBD159_1889_1891 | 0.00118351 |
| 266 | OBD159_1891 | CCCTCTCCAAACCTCCTTCTCTCAAG (SEQ ID NO: 2499) | OBD159_1889_1891 | 0.00118351 |
| 267 | OBD159_1895 | GCTTTACCTGTGTTACCACTCTATGC (SEQ ID NO: 2500) | OBD159_1893_1895 | 0.00149186 |
| 268 | OBD159_1895 | GCTTTACCTGTGTTACCACTCTATGC (SEQ ID NO: 2501) | OBD159_1893_1895 | 0.00149186 |
| 269 | OBD159_1899 | TGGGTTTGGTAGGGCTTTATTCCAGC (SEQ ID NO: 2502) | OBD159_1897_1899 | 0.003011204 |
| 270 | OBD159_1899 | TGGGTTTGGTAGGGCTTTATTCCAGC (SEQ ID NO: 2503) | OBD159_1897_1899 | 0.003011204 |
| 271 | OBD159_1903 | GGAGGAGGTTCACACTACGGGATAAA (SEQ ID NO: 2504) | OBD159_1901_1903 | 0.001177423 |
| 272 | OBD159_1903 | GGAGGAGGTTCACACTACGGGATAAA (SEQ ID NO: 2505) | OBD159_1901_1903 | 0.001177423 |
| 273 | OBD159_1907 | ATGGCATTCCCTGATTTCCCTGGATG (SEQ ID NO: 2506) | OBD159_1905_1907 | 0.000802563 |
| 274 | OBD159_1907 | ATGGCATTCCCTGATTTCCCTGGATG (SEQ ID NO: 2507) | OBD159_1905_1907 | 0.000802563 |
| 275 | OBD159_1911 | GAACACCCTAAACGAGCAGGAGAT (SEQ ID NO: 2508) | OBD159_1909_1911 | 0.000582061 |
| 276 | OBD159_1911 | GAACACCCTAAACGAGCAGGAGAT (SEQ ID NO: 2509) | OBD159_1909_1911 | 0.000582061 |
| 277 | OBD159_1915 | CCACTTCCATCCCCTTCACCACT (SEQ ID NO: 2510) | OBD159_1913_1915 | 0.00126299 |
| 278 | OBD159_1915 | CCACTTCCATCCCCTTCACCACT (SEQ ID NO: 2511) | OBD159_1913_1915 | 0.00126299 |

TABLE 3.c8-continued

| | PCR-Primer2_ID | PCR_Primer2 | Marker | GLMNET |
|---|---|---|---|---|
| 279 | OBD159_1919 | GAGAAAGGAGAGGGAAAACAGTGGGC (SEQ ID NO: 2512) | OBD159_1917_1919 | 0.000643972 |
| 280 | OBD159_1919 | GAGAAAGGAGAGGGAAAACAGTGGGC (SEQ ID NO: 2513) | OBD159_1917_1919 | 0.000643972 |
| 281 | OBD159_1923 | CTCTGCTGTGGGTGGTGTTGAATGTC (SEQ ID NO: 2514) | OBD159_1921_1923 | 0.001555442 |
| 282 | OBD159_1923 | CTCTGCTGTGGGTGGTGTTGAATGTC (SEQ ID NO: 2515) | OBD159_1921_1923 | 0.001555442 |
| 283 | OBD159_1927 | GGGTCTTGCCAGTAAGTTCTGAATGG (SEQ ID NO: 2516) | OBD159_1925_1927 | 0.000396146 |
| 284 | OBD159_1927 | GGGTCTTGCCAGTAAGTTCTGAATGG (SEQ ID NO: 2517) | OBD159_1925_1927 | 0.000396146 |
| 285 | OBD159_1931 | GAGAGTCACTAAGTCCAATCTATTCT (SEQ ID NO: 2518) | OBD159_1929_1931 | 0.000368359 |
| 286 | OBD159_1931 | GAGAGTCACTAAGTCCAATCTATTCT (SEQ ID NO: 2519) | OBD159_1929_1931 | 0.000368359 |
| 287 | OBD159_1935 | GGGACTCCAGATTGGTTGGCTGC (SEQ ID NO: 2520) | OBD159_1933_1935 | 0.000316159 |
| 288 | OBD159_1935 | GGGACTCCAGATTGGTTGGCTGC (SEQ ID NO: 2521) | OBD159_1933_1935 | 0.000316159 |
| 289 | OBD159_1939 | GCTGAAGACTTGGTCAAACCTATGGC (SEQ ID NO: 2522) | OBD159_1937_1939 | 0.002317868 |
| 290 | OBD159_1939 | GCTGAAGACTTGGTCAAACCTATGGC (SEQ ID NO: 2523) | OBD159_1937_1939 | 0.002317868 |
| 291 | OBD159_1943 | CACAGACCAAGGACCCTAACCAC (SEQ ID NO: 2524) | OBD159_1941_1943 | 0.001584871 |
| 292 | OBD159_1943 | CACAGACCAAGGACCCTAACCAC (SEQ ID NO: 2525) | OBD159_1941_1943 | 0.001584871 |
| 293 | OBD159_1947 | CTCTTTCTGAGGCTTTTGTTCATA (SEQ ID NO: 2526) | OBD159_1945_1947 | 0.001610864 |
| 294 | OBD159_1947 | CTCTTTCTGAGGCTTTTGTTCATA (SEQ ID NO: 2527) | OBD159_1945_1947 | 0.001610864 |
| 295 | OBD159_1951 | TTCCTTCCCCAGGGTTATTCCTTG (SEQ ID NO: 2528) | OBD159_1949_1951 | 0.000903487 |
| 296 | OBD159_1951 | TTCCTTCCCCAGGGTTATTCCTTG (SEQ ID NO: 2529) | OBD159_1949_1951 | 0.000903487 |
| 297 | OBD159_1955 | GCTCATAGAAGAAGCCTTTGGGC (SEQ ID NO: 2530) | OBD159_1953_1955 | 0.001642727 |
| 298 | OBD159_1955 | GCTCATAGAAGAAGCCTTTGGGC (SEQ ID NO: 2531) | OBD159_1953_1955 | 0.001642727 |
| 299 | OBD159_1959 | GCTACCTTTCCAGTTAGGGATTCAGC (SEQ ID NO: 2532) | OBD159_1957_1959 | 0.001162769 |
| 300 | OBD159_1959 | GCTACCTTTCCAGTTAGGGATTCAGC (SEQ ID NO: 2533) | OBD159_1957_1959 | 0.001162769 |
| 301 | OBD159_1963 | CCACTTCTTTGCTGGCTAACAGGGAG (SEQ ID NO: 2534) | OBD159_1961_1963 | 0.001956069 |
| 302 | OBD159_1963 | CCACTTCTTTGCTGGCTAACAGGGAG (SEQ ID NO: 2535) | OBD159_1961_1963 | 0.001956069 |
| 303 | OBD159_1967 | TGTGTATTCTGCTGATGTTGGTGGAA (SEQ ID NO: 2536) | OBD159_1965_1967 | 0.001893861 |
| 304 | OBD159_1967 | TGTGTATTCTGCTGATGTTGGTGGAA (SEQ ID NO: 2537) | OBD159_1965_1967 | 0.001893861 |

TABLE 3.c8-continued

| | PCR-Primer2_ID | PCR_Primer2 | Marker | GLMNET |
|---|---|---|---|---|
| 305 | OBD159_1971 | CAGCAGAGTATTTGGAGTTGAAAA (SEQ ID NO: 2538) | OBD159_1969_1971 | 0.000425074 |
| 306 | OBD159_1971 | CAGCAGAGTATTTGGAGTTGAAAA (SEQ ID NO: 2539) | OBD159_1969_1971 | 0.000425074 |
| 307 | OBD159_1975 | CTCACGCCTGGGAGAGTTTGTGC (SEQ ID NO: 2540) | OBD159_1973_1975 | 0.001135474 |
| 308 | OBD159_1975 | CTCACGCCTGGGAGAGTTTGTGC (SEQ ID NO: 2541) | OBD159_1973_1975 | 0.001135474 |
| 309 | OBD159_1979 | GCTGAGTTGAGCCTTCTGCTTGG (SEQ ID NO: 2542) | OBD159_1977_1979 | 0.001365566 |
| 310 | OBD159_1979 | GCTGAGTTGAGCCTTCTGCTTGG (SEQ ID NO: 2543) | OBD159_1977_1979 | 0.001365566 |
| 311 | OBD159_1983 | ATGTGCTAATCTGGAAGACTCTGTC (SEQ ID NO: 2544) | OBD159_1981_1983 | 0.001999821 |
| 312 | OBD159_1983 | ATGTGCTAATCTGGAAGACTCTGTC (SEQ ID NO: 2545) | OBD159_1981_1983 | 0.001999821 |
| 313 | OBD159_1987 | GCAGTAAAATCCATAAGAATGAGCAG (SEQ ID NO: 2546) | OBD159_1985_1987 | 0.000704424 |
| 314 | OBD159_1987 | GCAGTAAAATCCATAAGAATGAGCAG (SEQ ID NO: 2547) | OBD159_1985_1987 | 0.000704424 |
| 315 | OBD159_1991 | TGGGAAGTGAGAAGAGGAGGTGGCAA (SEQ ID NO: 2548) | OBD159_1989_1991 | 0.001666152 |
| 316 | OBD159_1991 | TGGGAAGTGAGAAGAGGAGGTGGCAA (SEQ ID NO: 2549) | OBD159_1989_1991 | 0.001666152 |
| 317 | OBD159_1995 | CTAAGTGTCAGTCAACCCCTCTCCTA (SEQ ID NO: 2550) | OBD159_1993_1995 | 0.001044019 |
| 318 | OBD159_1995 | CTAAGTGTCAGTCAACCCCTCTCCTA (SEQ ID NO: 2551) | OBD159_1993_1995 | 0.001044019 |
| 319 | OBD159_1999 | AGACAGGTGGTGCTGATTCATTGGTG (SEQ ID NO: 2552) | OBD159_1997_1999 | 0.002021208 |
| 320 | OBD159_1999 | AGACAGGTGGTGCTGATTCATTGGTG (SEQ ID NO: 2553) | OBD159_1997_1999 | 0.002021208 |
| 321 | OBD159_2003 | GTTTATTCACCTTCTCCCTGGTCTCA (SEQ ID NO: 2554) | OBD159_2001_2003 | 0.001330657 |
| 322 | OBD159_2003 | GTTTATTCACCTTCTCCCTGGTCTCA (SEQ ID NO: 2555) | OBD159_2001_2003 | 0.001330657 |
| 323 | OBD159_2007 | GGGATGCTTGCCTTGATGAGTGC (SEQ ID NO: 2556) | OBD159_2005_2007 | 0.002083668 |
| 324 | OBD159_2007 | GGGATGCTTGCCTTGATGAGTGC (SEQ ID NO: 2557) | OBD159_2005_2007 | 0.002083668 |
| 325 | OBD159_2011 | CCTGCGAGGCTTCTGAGCAACAG (SEQ ID NO: 2558) | OBD159_2009_2011 | 0.000189924 |
| 326 | OBD159_2011 | CCTGCGAGGCTTCTGAGCAACAG (SEQ ID NO: 2559) | OBD159_2009_2011 | 0.000189924 |
| 327 | OBD159_2015 | AAAGGGCTCCTCTGACCCATAAACCT (SEQ ID NO: 2560) | OBD159_2013_2015 | 0.00176577 |
| 328 | OBD159_2015 | AAAGGGCTCCTCTGACCCATAAACCT (SEQ ID NO: 2561) | OBD159_2013_2015 | 0.00176577 |
| 329 | OBD159_2019 | CAGAGGTAAGGACAACTGCCAATA (SEQ ID NO: 2562) | OBD159_2017_2019 | 0.002913338 |
| 330 | OBD159_2019 | CAGAGGTAAGGACAACTGCCAATA (SEQ ID NO: 2563) | OBD159_2017_2019 | 0.002913338 |

TABLE 3.c9

| Gene |
| --- |
| 221 rs150252171; rs288604 |
| 222 rs150252171; rs288604 |
| 223 KCNK12; MSH2; rs267608023 |
| 224 KCNK12; MSH2; rs267608023 |
| 225 RIN2; rs4813376; rs6046396; rs16981145 |
| 226 RIN2; rs4813376; rs6046396; rs16981145 |
| 227 BBX; rs11710737 |
| 228 BBX; rs11710737 |
| 229 CX3CR1; XIRP1; rs1877563; rs3732378; rs3732379; rs9868689; rs12636547; rs2669845; rs11715522; rs2853707 |
| 230 CX3CR1; XIRP1; rs1877563; rs3732378; rs3732379; rs9868689; rs12636547; rs2669845; rs11715522; rs2853707 |
| 231 CNKSR3; IPCEF1; OPRM1 |
| 232 CNKSR3; IPCEF1; OPRM1 |
| 233 LRFN2; rs148347825 |
| 234 LRFN2; rs148347825 |
| 235 rs12127195 |
| 236 rs12127195 |
| 237 GUCY1A2 |
| 238 GUCY1A2 |
| 239 TDRD3; rs7337573 |
| 240 TDRD3; rs7337573 |
| 241 CLEC14A; SSTR1; rs11622412 |
| 242 CLEC14A; SSTR1; rs11622412 |
| 243 PDXDC1; rs4003228 |
| 244 PDXDC1; rs4003228 |
| 245 ASZ1; WNT2; rs2188554; rs10249651 |
| 246 ASZ1; WNT2; rs2188554; rs10249651 |
| 247 CD58; IGSF3; rs724160030 |
| 248 CD58; IGSF3; rs724160030 |
| 249 HNMT |
| 250 HNMT |
| 251 SLC13A3; rs847058; rs6066043 |
| 252 SLC13A3; rs847058; rs6066043 |
| 253 MEGF10; rs387907071; rs387907072; rs199750143; rs794726678; rs989552169; rs794726677 |
| 254 MEGF10; rs387907071; rs387907072; rs199750143; rs794726678; rs989552169; rs794726677 |
| 255 TMEM182; rs12105421 |
| 256 TMEM182; rs12105421 |
| 257 rs12671937; rs739385 |
| 258 rs12671937; rs739385 |
| 259 DLG2; rs790356 |
| 260 DLG2; rs790356 |
| 261 C1orf216; CLSPN; PSMB2 |
| 262 C1orf216; CLSPN; PSMB2 |
| 263 rs12144699; rs6700125 |
| 264 rs12144699; rs6700125 |
| 265 NRG3; rs17101017; rs17685233 |
| 266 NRG3; rs17101017; rs17685233 |
| 267 HAUS2; LRRC57; SNAP23 |
| 268 HAUS2; LRRC57; SNAP23 |
| 269 MAP2; rs9288410 |
| 270 MAP2; rs9288410 |
| 271 ATP6V1E2; PIGF; RHOQ |
| 272 ATP6V1E2; PIGF; RHOQ |
| 273 GAFA3; PGM2; TBC1D1; rs17578878 |
| 274 GAFA3; PGM2; TBC1D1; rs17578878 |
| 275 ZNF608; rs4357030 |
| 276 ZNF608; rs4357030 |
| 277 rs167025; rs80337801 |
| 278 rs167025; rs80337801 |
| 279 OLIG3; rs13201877 |
| 280 OLIG3; rs13201877 |
| 281 KBTBD8; SUCLG2 |
| 282 KBTBD8; SUCLG2 |
| 283 FGF12; MB21D2 |
| 284 FGF12; MB21D2 |
| 285 NA |
| 286 NA |
| 287 rs5917854 |
| 288 rs5917854 |
| 289 MAP2; UNC80; rs146432517 |
| 290 MAP2; UNC80; rs146432517 |
| 291 LIPC; rs113298164; rs1365771; rs60439253; rs6494025; rs7178362 |
| 292 LIPC; rs113298164; rs1365771; rs60439253; rs6494025; rs7178362 |
| 293 MBNL2; OXGR1 |
| 294 MBNL2; OXGR1 |
| 295 rs953861; rs6556411; rs6556412; rs4379175; rs10045431 |
| 296 rs953861; rs6556411; rs6556412; rs4379175; rs10045431 |

TABLE 3.c9-continued

| | Gene |
|---|---|
| 297 | rs12671937; rs739385 |
| 298 | rs12671937; rs739385 |
| 299 | rs9436866; rs10789285 |
| 300 | rs9436866; rs10789285 |
| 301 | ST6GALNAC3; rs12095069 |
| 302 | ST6GALNAC3; rs12095069 |
| 303 | CAPS2; KCNC2 |
| 304 | CAPS2; KCNC2 |
| 305 | RFC3; rs12429186 |
| 306 | RFC3; rs12429186 |
| 307 | PNMAL1; PNMAL2; PPP5D1 |
| 308 | PNMAL1; PNMAL2; PPP5D1 |
| 309 | rs16864170; rs10929925 |
| 310 | rs16864170; rs10929925 |
| 311 | ADRBK2; rs8142284; rs12158587 |
| 312 | ADRBK2; rs8142284; rs12158587 |
| 313 | FAT4; rs1039808 |
| 314 | FAT4; rs1039808 |
| 315 | rs80337801; rs12517545; rs167025 |
| 316 | rs80337801; rs12517545; rs167025 |
| 317 | EXOC2; rs116446171; rs950039; rs9392056; rs6918152; rs2476847; rs12210050 |
| 318 | EXOC2; rs116446171; rs950039; rs9392056; rs6918152; rs2476847; rs12210050 |
| 319 | MSRA; rs10087178; rs10107815; rs73191547; rs7012397 |
| 320 | MSRA; rs10087178; rs10107815; rs73191547; rs7012397 |
| 321 | rs500816; rs7015657 |
| 322 | rs500816; rs7015657 |
| 323 | RAPGEF4; rs733331 |
| 324 | RAPGEF4; rs733331 |
| 325 | PDE4B; rs490094 |
| 326 | PDE4B; rs490094 |
| 327 | ELK3; rs4762284 |
| 328 | ELK3; rs4762284 |
| 329 | MBNL2; OXGR1 |
| 330 | MBNL2; OXGR1 |

TABLE 3.d1

| | Probe | GeneLocus |
|---|---|---|
| 331 | ORF175_1_50024584_50030848_50095924_50103322_RF | AGBL4; ELAVL4; rs11583200 |
| 332 | ORF175_1_50024584_50030848_50095924_50103322_RF | AGBL4; ELAVL4; rs11583200 |
| 333 | ORF176_14_39721868_39724679_39792290_39806170_RR | rs17109786; rs148431766 |
| 334 | ORF176_14_39721868_39724679_39792290_39806170_RR | rs17109786; rs148431766 |
| 335 | ORF176_19_46479838_46481514_46541191_46545048_FF | PNMAL1; PNMAL2; PPP5D1 |
| 336 | ORF176_19_46479838_46481514_46541191_46545048_FF | PNMAL1; PNMAL2; PPP5D1 |
| 337 | ORF176_20_1283617_1286683_1342450_1344929_RF | FKBP1A; RAD21L1; RP11-314N13.10; SDCBP2; SNPH; rs35367003 |
| 338 | ORF176_20_1283617_1286683_1342450_1344929_RF | FKBP1A; RAD21L1; RP11-314N13.10; SDCBP2; SNPH; rs35367003 |
| 339 | ORF177_13_36604370_36613394_36670823_36673255_FR | SERTM1; rs11619726 |
| 340 | ORF177_13_36604370_36613394_36670823_36673255_FR | SERTM1; rs11619726 |
| 341 | ORF177_6_148168867_148173481_148222776_148224891_RF | rs6914622; rs9497965; rs9497975 |
| 342 | ORF177_6_148168867_148173481_148222776_148224891_RF | rs6914622; rs9497965; rs9497975 |
| 343 | ORF177_X_40505666_40507827_40520869_40522158_RR | BCOR; rs2968915 |
| 344 | ORF177_X_40505666_40507827_40520869_40522158_RR | BCOR; rs2968915 |
| 345 | ORF179_5_7540900_7542383_7555641_7557907_FR | ADCY2; rs17231202; rs10512928; rs884964; rs12522444; rs11134242 |
| 346 | ORF179_5_7540900_7542383_7555641_7557907_FR | ADCY2; rs17231202; rs10512928; rs884964; rs12522444; rs11134242 |
| 347 | ORF18_10_121564423_121570750_121595209_121596934_FR | FGFR2; rs148514974; rs10510097; rs4752569; rs3750817; rs7895676; rs10736303; rs11200014; rs2981579; rs1078806; rs2981578; rs35054928; rs2981575; rs1219648; rs1219642; rs2912774; rs2936870; rs45631563; rs2420946; rs3135724; rs2981582; rs3135718; rs755001161 |
| 348 | ORF18_10_121564423_121570750_121595209_121596934_FR | FGFR2; rs148514974; rs10510097; rs4752569; rs3750817; rs7895676; rs10736303; rs11200014; rs2981579; rs1078806; rs2981578; rs35054928; rs2981575; rs1219648; rs1219642; rs2912774; rs2936870; rs45631563; rs2420946; rs3135724; rs2981582; rs3135718; rs755001161 |
| 349 | ORF18_18_23859209_23862260_23887990_23889494_RR | LAMA3; rs1057516512; rs80356678; rs1057516743; rs1057517023; rs1057516475; rs1057517235; rs1057517367; rs7237244 |
| 350 | ORF18_18_23859209_23862260_23887990_23889494_RR | LAMA3; rs1057516512; rs80356678; |

TABLE 3.d1-continued

| Probe | GeneLocus |
|---|---|
| | rs1057516743; rs1057517023; rs1057516475; |
| | rs1057517235; rs1057517367; rs7237244 |
| 351 ORF18_2_79981700_79985274_80035781_80037454_RF | CTNNA2; rs6738962 |
| 352 ORF18_2_79981700_79985274_80035781_80037454_RF | CTNNA2; rs6738962 |
| 353 ORF18_20_19885722_19887043_19898126_19900554_RR | RIN2; rs6046396 |
| 354 ORF18_20_19885722_19887043_19898126_19900554_RR | RIN2; rs6046396 |
| 355 ORF18_21_14553845_14555723_14583254_14600479_FF | AF165138.7; HSPA13; SAMSN1 |
| 356 ORF18_21_14553845_14555723_14583254_14600479_FF | AF165138.7; HSPA13; SAMSN1 |
| 357 ORF18_3_46488317_46491053_46529967_46536322_FF | LRRC2; LTF; RTP3 |
| 358 ORF18_3_46488317_46491053_46529967_46536322_FF | LRRC2; LTF; RTP3 |
| 359 ORF18_3_64194265_64195323_64266976_64268244_FR | PRICKLE2; rs17404667 |
| 360 ORF18_3_64194265_64195323_64266976_64268244_FR | PRICKLE2; rs17404667 |
| 361 ORF18_6_169230654_169232256_169286051_169290790_RR | THBS2; rs9406328; rs761646500; rs116146467 |
| 362 ORF18_6_169230654_169232256_169286051_169290790_RR | THBS2; rs9406328; rs761646500; rs116146467 |
| 363 ORF180_3_69108055_69110182_69214794_69217124_RF | ARL6IP5; FRMD4B; LMOD3; rs724159964; |
| | rs727502798; rs727502799; rs724159965; |
| | rs727502797; rs6787362; rs6806528 |
| 364 ORF180_3_69108055_69110182_69214794_69217124_RF | ARL6IP5; FRMD4B; LMOD3; rs724159964; |
| | rs727502798; rs727502799; rs724159965; |
| | rs727502797; rs6787362; rs6806528 |
| 365 ORF180_4_88335985_88339586_88412084_88413091_RR | HERC6; rs12512051 |
| 366 ORF180_4_88335985_88339586_88412084_88413091_RR | HERC6; rs12512051 |
| 367 ORF181_11_84860156_84861867_84918402_84924862_RR | DLG2 |
| 368 ORF181_11_84860156_84861867_84918402_84924862_RR | DLG2 |
| 369 ORF182_1_206383244_206385305_206447306_206449267_FF | SRGAP2; rs2987927; rs2480408 |
| 370 ORF182_1_206383244_206385305_206447306_206449267_FF | SRGAP2; rs2987927; rs2480408 |
| 371 ORF183_15_74122056_74124006_74177775_74179553_FF | ISLR; ISLR2; STRA6; rs376998994; rs397514639 |
| 372 ORF183_15_74122056_74124006_74177775_74179553_FF | ISLR; ISLR2; STRA6; rs376998994; rs397514639 |
| 373 ORF183_2_56270885_56277617_56323476_56329636_FF | CCDC85A; rs6747380 |
| 374 ORF183_2_56270885_56277617_56323476_56329636_FF | CCDC85A; rs6747380 |
| 375 ORF183_21_45837532_45839027_45849840_45851551_FF | PCBP3; rs56127133 |
| 376 ORF183_21_45837532_45839027_45849840_45851551_FF | PCBP3; rs56127133 |
| 377 ORF184_Y_14466176_14474218_14520608_14523189_FR | NLGN4Y |
| 378 ORF184_Y_14466176_14474218_14520608_14523189_FR | NLGN4Y |
| 379 ORF187_2_21325579_21332004_21374795_21382106_FR | rs2337901; rs11897825 |
| 380 ORF187_2_21325579_21332004_21374795_21382106_FR | rs2337901; rs11897825 |
| 381 ORF187_6_70128487_70130693_70187099_70190406_RF | COL19A1; rs771562232; rs658805 |
| 382 ORF187_6_70128487_70130693_70187099_70190406_RF | COL19A1; rs771562232; rs658805 |
| 383 ORF187_7_37211489_37214787_37231292_37233848_RF | ELMO1; rs73112661 |
| 384 ORF187_7_37211489_37214787_37231292_37233848_RF | ELMO1; rs73112661 |
| 385 ORF187_8_74044912_74046076_74077219_74079715_RF | LY96; rs6472827 |
| 386 ORF187_8_74044912_74046076_74077219_74079715_RF | LY96; rs6472827 |
| 387 ORF188_11_104895593_104903291_104915537_104922612_RR | CASP4; rs497116 |
| 388 ORF188_11_104895593_104903291_104915537_104922612_RR | CASP4; rs497116 |
| 389 ORF188_9_117491884_117500665_117513941_117521837_RR | ASTN2; rs2771051 |
| 390 ORF188_9_117491884_117500665_117513941_117521837_RR | ASTN2; rs2771051 |
| 391 ORF19_1_177028175_177032504_177116397_177122010_RR | ASTN1; rs2861887; rs228014 |
| 392 ORF19_1_177028175_177032504_177116397_177122010_RR | ASTN1; rs2861887; rs228014 |
| 393 ORF19_1_177129764_177133067_177178719_177181987_FR | ASTN1; BRINP2; rs2861887 |
| 394 ORF19_1_177129764_177133067_177178719_177181987_FR | ASTN1; BRINP2; rs2861887 |
| 395 ORF19_1_76032659_76035831_76083373_76086337_RR | ST6GALNAC3; rs12095069 |
| 396 ORF19_1_76032659_76035831_76083373_76086337_RR | ST6GALNAC3; rs12095069 |
| 397 ORF19_10_76413183_76419817_76444465_76451876_FR | C10orf11; rs11593840; rs10509373 |
| 398 ORF19_10_76413183_76419817_76444465_76451876_FR | C10orf11; rs11593840; rs10509373 |
| 399 ORF19_15_59205508_59210997_59259334_59261999_RR | LDHAL6B; MYO1E; rs7165001; rs387906807; |
| | rs2306786 |
| 400 ORF19_15_59205508_59210997_59259334_59261999_RR | LDHAL6B; MYO1E; rs7165001; rs387906807; |
| | rs2306786 |
| 401 ORF19_18_35655009_35656946_35676499_35681362_RR | GALNT1; rs17647532 |
| 402 ORF19_18_35655009_35656946_35676499_35681362_RR | GALNT1; rs17647532 |
| 403 ORF19_2_106158642_106160954_106220910_106222156_FF | C2orf40; UXS1; rs6738485 |
| 404 ORF19_2_106158642_106160954_106220910_106222156_FF | C2orf40; UXS1; rs6738485 |
| 405 ORF19_2_20261188_20263397_20361646_20369312_FF | PUM2; rs111612372 |
| 406 ORF19_2_20261188_20263397_20361646_20369312_FF | PUM2; rs111612372 |
| 407 ORF19_2_217551078_217557187_217605412_217608263_RR | DIRC3; rs6435999 |
| 408 ORF19_2_217551078_217557187_217605412_217608263_RR | DIRC3; rs6435999 |
| 409 ORF19_20_11126224_11127995_11191868_11199236_FR | rs6040399; rs77790871 |
| 410 ORF19_20_11126224_11127995_11191868_11199236_FR | rs6040399; rs77790871 |
| 411 ORF19_4_125340607_125343598_125382298_125392915_FR | FAT4; rs1039808 |
| 412 ORF19_4_125340607_125343598_125382298_125392915_FR | FAT4; rs1039808 |
| 413 ORF19_6_5723608_5725733_5745537_5748323_RR | FARS2; rs775690041 |
| 414 ORF19_6_5723608_5725733_5745537_5748323_RR | FARS2; rs775690041 |
| 415 ORF191_13_45859224_45860475_45923601_45927773_RR | SIAH3; ZC3H13 |
| 416 ORF191_13_45859224_45860475_45923601_45927773_RR | SIAH3; ZC3H13 |
| 417 ORF191_13_74443077_74451062_74472806_74486278_FR | rs17714988; rs17718828 |
| 418 ORF191_13_74443077_74451062_74472806_74486278_FR | rs17714988; rs17718828 |
| 419 ORF193_1_66143825_66151966_66218811_66223865_FR | PDE4B; rs490094; rs10454453; rs486438; |
| | rs567279; rs6588190 |

TABLE 3.d1-continued

| Probe | GeneLocus |
|---|---|
| 420 ORF193_1_66143825_66151966_66218811_66223865_FR | PDE4B; rs490094; rs10454453; rs486438; rs567279; rs6588190 |
| 421 ORF194_13_74472806_74486278_74508577_74514808_RF | rs17714988; rs17718828 |
| 422 ORF194_13_74472806_74486278_74508577_74514808_RF | rs17714988; rs17718828 |
| 423 ORF194_2_19641438_19647635_19660555_19664933_RF | rs10856789; rs16986953 |
| 424 ORF194_2_19641438_19647635_19660555_19664933_RF | rs10856789; rs16986953 |
| 425 ORF194_6_27448356_27449458_27517801_27518934_FF | ZNF184; rs34196306; rs149866169; rs34864796; rs16867808; rs2205829; rs13195040 |
| 426 ORF194_6_27448356_27449458_27517801_27518934_FF | ZNF184; rs34196306; rs149866169; rs34864796; rs16867808; rs2205829; rs13195040 |
| 427 ORF194_9_105414393_105415801_105438651_105443203_FF | FSD1L; SLC44A1 |
| 428 ORF194_9_105414393_105415801_105438651_105443203_FF | FSD1L; SLC44A1 |
| 429 ORF195_2_161568697_161570567_161580634_161587484_RF | SLC4A10; rs56037433 |
| 430 ORF195_2_161568697_161570567_161580634_161587484_RF | SLC4A10; rs56037433 |
| 431 ORF196_6_84687731_84692812_84775145_84786636_RF | TBX18; rs760905589; rs869320679; rs797045022; rs77693245; rs72912698 |
| 432 ORF196_6_84687731_84692812_84775145_84786636_RF | TBX18; rs760905589; rs869320679; rs797045022; rs77693245; rs72912698 |
| 433 ORF197_7_107251976_107254546_107284754_107287455_FR | COG5; rs773281248; rs3815148 |
| 434 ORF197_7_107251976_107254546_107284754_107287455_FR | COG5; rs773281248; rs3815148 |
| 435 ORF198_8_119154139_119162140_119209458_119214583_RR | MAL2; rs2468186; rs1425053; rs6989684 |
| 436 ORF198_8_119154139_119162140_119209458_119214583_RR | MAL2; rs2468186; rs1425053; rs6989684 |

TABLE 3.d2

| | Probe_Count_Total | Probe_Count_Sig | HyperG_Stats |
|---|---|---|---|
| 331 | 93; 58; NA | 1; 5; 1; 1; NA | 0.093070545; 0.156450038; 0.234279681; 0.210195578; NA |
| 332 | 93; 58; NA | 1; 5; 1; 1; NA | 0.093070545; 0.156450038; 0.234279681; 0.210195578; NA |
| 333 | NA | NA | NA |
| 334 | NA | NA | NA |
| 335 | 28; 32; 32 | 3; 4; 3; 4; 3; 4 | 0.071800115; 0.02285211; 0.09275567; 0.033810966; 0.09275567; 0.033810966 |
| 336 | 28; 32; 32 | 3; 4; 3; 4; 3; 4 | 0.071800115; 0.02285211; 0.09275567; 0.033810966; 0.09275567; 0.033810966 |
| 337 | 20; 10; 30; 30; 16; NA | 1; 1; 1; 1; 1; 1; 1; 1; 1; NA | 0.366490901; 0.372098641; 0.272678156; 0.285987033; 0.36936157; 0.363021342; 0.36936157; 0.363021342; 0.343724359; 0.353547066; NA |
| 338 | 20; 10; 30; 30; 16; NA | 1; 1; 1; 1; 1; 1; 1; 1; 1; NA | 0.366490901; 0.372098641; 0.272678156; 0.285987033; 0.36936157; 0.363021342; 0.36936157; 0.363021342; 0.343724359; 0.353547066; NA |
| 339 | 29; NA | 2; 2; NA | 0.211050406; 0.22548219; NA |
| 340 | 29; NA | 2; 2; NA | 0.211050406; 0.22548219; NA |
| 341 | NA | NA | NA |
| 342 | NA | NA | NA |
| 343 | 3; NA | 3; 1; NA | 5.91e−05; 0.042102538; NA |
| 344 | 3; NA | 3; 1; NA | 5.91e−05; 0.042102538; NA |
| 345 | 90; NA | 3; 3; NA | 0.219233776; 0.208104371; NA |
| 346 | 90; NA | 3; 3; NA | 0.219233776; 0.208104371; NA |
| 347 | 190; NA | 5; 4; NA | 0.112399625; 0.054978865; NA |
| 348 | 190; NA | 5; 4; NA | 0.112399625; 0.054978865; NA |
| 349 | 82; NA | 1; 2; NA | 0.127264367; 0.188524907; NA |
| 350 | 82; NA | 1; 2; NA | 0.127264367; 0.188524907; NA |
| 351 | 40; NA | 2; 3; NA | 0.261899069; 0.150241062; NA |
| 352 | 40; NA | 2; 3; NA | 0.261899069; 0.150241062; NA |
| 353 | 40; NA | 4; 4; NA | 0.096861772; 0.075450093; NA |
| 354 | 175; NA | 4; 4; NA | 0.096861772; 0.075450093; NA |
| 355 | 16; 8; 10 | 1; 1; 1; 1; 1; 1 | 0.343724359; 0.353547066; 0.236185646; 0.249326315; 0.272678156; 0.285987033 |
| 356 | 16; 8; 10 | 1; 1; 1; 1; 1; 1 | 0.343724359; 0.353547066; 0.236185646; 0.249326315; 0.272678156; 0.285987033 |
| 357 | 48; 15; 43 | 1; 1; 1; 1; 1; 1 | 0.288729231; 0.267628012; 0.335307856; 0.346011739; 0.315614698; 0.297350686 |
| 358 | 48; 15; 43 | 1; 1; 1; 1; 1; 1 | 0.288729231; 0.267628012; 0.335307856; 0.346011739; 0.315614698; 0.297350686 |
| 359 | 41; NA | 1; 2; NA | 0.325868449; 0.271883499; NA |
| 360 | 41; NA | 1; 2; NA | 0.325868449; 0.271883499; NA |
| 361 | 46; NA | 2; 3; NA | 0.273777277; 0.178397403; NA |
| 362 | 46; NA | 2; 3; NA | 0.273777277; 0.178397403; NA |
| 363 | 24; 151; 84; NA | 1; 1; 1; 2; 1; 2; NA | 0.375122937; 0.375945017; 0.014886343; 0.032692527; 0.120373828; 0.181549809; NA |
| 364 | 24; 151; 84; NA | 1; 1; 1; 2; 1; 2; NA | 0.375122937; 0.375945017; 0.014886343; 0.032692527; 0.120373828; 0.181549809; NA |
| 365 | 19; NA | 1; 1; NA | 0.362286681; 0.369026848; NA |
| 366 | 19; NA | 1; 1; NA | 0.362286681; 0.369026848; NA |
| 367 | 22 | 3; 3 | 0.042821316; 0.050708849 |

TABLE 3.d2-continued

| | Probe_Count_Total | Probe_Count_Sig | HyperG_Stats |
|---|---|---|---|
| 368 | 22 | 3; 3 | 0.042821316; 0.050708849 |
| 369 | 41; NA | 2; 2; NA | 0.26460109; 0.271883499; NA |
| 370 | 41; NA | 2; 2; NA | 0.26460109; 0.271883499; NA |
| 371 | 37; 22; 52; NA | 1; 1; 1; 1; 1; 1; NA | 0.34481748; 0.331269672; 0.372324987; 0.375573766; 0.266738689; 0.244043749; NA |
| 372 | 37; 22; 52; NA | 1; 1; 1; 1; 1; 1; NA | 0.34481748; 0.331269672; 0.372324987; 0.375573766; 0.266738689; 0.244043749; NA |
| 373 | 35; NA | 4; 2; NA | 0.035189793; 0.255336195; NA |
| 374 | 35; NA | 4; 2; NA | 0.035189793; 0.255336195; NA |
| 375 | 37; NA | 1; 1; NA | 0.34481748; 0.331269672; NA |
| 376 | 37; NA | 1; 1; NA | 0.34481748; 0.331269672; NA |
| 377 | 13 | 1; 1 | 0.314642613; 0.32680192 |
| 378 | 13 | 1; 1 | 0.314642613; 0.32680192 |
| 379 | NA | NA | NA |
| 380 | NA | NA | NA |
| 381 | 18; NA | 3; 3; NA | 0.026589963; 0.031898647; NA |
| 382 | 18; NA | 3; 3; NA | 0.026589963; 0.031898647; NA |
| 383 | 135; NA | 4; 2; NA | 0.167299602; 0.052146884; NA |
| 384 | 135; NA | 4; 2; NA | 0.167299602; 0.052146884; NA |
| 385 | 29; NA | 2; 2; NA | 0.211050406; 0.22548219; NA |
| 386 | 29; NA | 2; 2; NA | 0.211050406; 0.22548219; NA |
| 387 | 18; NA | 1; 1; NA | 0.357137933; 0.364965787; NA |
| 388 | 18; NA | 1; 1; NA | 0.357137933; 0.364965787; NA |
| 389 | 24; NA | 1; 1; NA | 0.375122937; 0.375945017; NA |
| 390 | 24; NA | 1; 1; NA | 0.375122937; 0.375945017; NA |
| 391 | 107; NA | 2; 3; NA | 0.132213333; 0.169050538; NA |
| 392 | 107; NA | 2; 3; NA | 0.132213333; 0.169050538; NA |
| 393 | 107; 123; NA | 2; 3; 1; 1; NA | 0.132213333; 0.169050538; 0.037152217; 0.02695001; NA |
| 394 | 107; 123; NA | 2; 3; 1; 1; NA | 0.132213333; 0.169050538; 0.037152217; 0.02695001; NA |
| 395 | 45; NA | 5; 5; NA | 0.022343156; 0.028833151; NA |
| 396 | 45; NA | 5; 5; NA | 0.022343156; 0.028833151; NA |
| 397 | 76; NA | 4; 4; NA | 0.169506823; 0.182516854; NA |
| 398 | 76; NA | 4; 4; NA | 0.169506823; 0.182516854; NA |
| 399 | 30; 45; NA | 1; 1; 1; 2; NA | 0.36936157; 0.363021342; 0.305019886; 0.276375861; NA |
| 400 | 30; 45; NA | 1; 1; 1; 2; NA | 0.36936157; 0.363021342; 0.305019886; 0.276375861; NA |
| 401 | 10; NA | 1; 1; NA | 0.272678156; 0.285987033; NA |
| 402 | 10; NA | 1; 1; NA | 0.272678156; 0.285987033; NA |
| 403 | 10; 10; NA | 1; 1; 1; 1; NA | 0.272678156; 0.285987033; 0.272678156; 0.285987033; NA |
| 404 | 10; 10; NA | 1; 1; 1; 1; NA | 0.272678156; 0.285987033; 0.272678156; 0.285987033; NA |
| 405 | 54; NA | 5; 6; NA | 0.040491239; 0.018151611; NA |
| 406 | 54; NA | 5; 6; NA | 0.040491239; 0.018151611; NA |
| 407 | 26; NA | 1; 1; NA | 0.375314357; 0.373699919; NA |
| 408 | 26; NA | 1; 1; NA | 0.375314357; 0.373699919; NA |
| 409 | NA | NA | NA |
| 410 | NA | NA | NA |
| 411 | 19; NA | 3; 4; NA | 0.030348034; 0.006361707; NA |
| 412 | 19; NA | 3; 4; NA | 0.030348034; 0.006361707; NA |
| 413 | 37; NA | 1; 2; NA | 0.34481748; 0.262259643; NA |
| 414 | 37; NA | 1; 2; NA | 0.34481748; 0.262259643; NA |
| 415 | 56; 50 | 3; 2; 3; 3 | 0.199907871; 0.267835203; 0.179388457; 0.193973801 |
| 416 | 56; 50 | 3; 2; 3; 3 | 0.199907871; 0.267835203; 0.179388457; 0.193973801 |
| 417 | NA | NA | NA |
| 418 | NA | NA | NA |
| 419 | 17; NA | 3; 2; NA | 0.023054538; 0.126473611; NA |
| 420 | 17; NA | 3; 2; NA | 0.023054538; 0.126473611; NA |
| 421 | NA | NA | NA |
| 422 | NA | NA | NA |
| 423 | NA | NA | NA |
| 424 | NA | NA | NA |
| 425 | 42; NA | 1; 1; NA | 0.320791853; 0.303213711; NA |
| 426 | 42; NA | 1; 1; NA | 0.320791853; 0.303213711; NA |
| 427 | 18; 18 | 2; 2; 2; 2 | 0.123103064; 0.136301816; 0.123103064; 0.136301816 |
| 428 | 18; 18 | 2; 2; 2; 2 | 0.123103064; 0.136301816; 0.123103064; 0.136301816 |
| 429 | 6; NA | 1; 1; NA | 0.191789359; 0.203777963; NA |
| 430 | 6; NA | 1; 1; NA | 0.191789359; 0.203777963; NA |
| 431 | 20; NA | 4; 5; NA | 0.005899409; 0.001067155; NA |
| 432 | 20; NA | 4; 5; NA | 0.005899409; 0.001067155; NA |
| 433 | 9; NA | 1; 1; NA | 0.255358235; 0.268692312; NA |
| 434 | 9; NA | 1; 1; NA | 0.255358235; 0.268692312; NA |
| 435 | 9; NA | 1; 1; NA | 0.255358235; 0.268692312; NA |
| 436 | 9; NA | 1; 1; NA | 0.255358235; 0.268692312; NA |

TABLE 3.d3

| | FDR_HyperG | Percent_Sig | logFC | AveExpr |
|---|---|---|---|---|
| 331 | 0.375519541; 0.376115439; 0.375519541; 0.376115439; NA | 1.08; 5.38; 1.72; 1.72; NA | −0.921517398 | −0.921517398 |
| 332 | 0.375519541; 0.376115439; 0.375519541; 0.376115439; NA | 1.08; 5.38; 1.72; 1.72; NA | −0.725657547 | −0.725657547 |
| 333 | NA | NA | −0.948082367 | −0.948082367 |
| 334 | NA | NA | −0.750194193 | −0.750194193 |
| 335 | 0.375519541; 0.376115439; 0.375519541; 0.376115439; 0.375519541; 0.376115439 | 10.71; 14.29; 9.38; 12.5; 9.38; 12.5 | −0.850894358 | −0.850894358 |
| 336 | 0.375519541; 0.376115439; 0.375519541; 0.376115439; 0.375519541; 0.376115439 | 10.71; 14.29; 9.38; 12.5; 9.38; 12.5 | −0.801014332 | −0.801014332 |
| 337 | 0.375519541; 0.376115439; 0.375519541; 0.376115439; 0.375519541; 0.376115439; 0.375519541; 0.376115439; 0.375519541; 0.376115439; NA | 5; 5; 10; 10; 3.33; 3.33; 3.33; 3.33; 6.25; 6.25; NA | −0.960853701 | −0.960853701 |
| 338 | 0.375519541; 0.376115439; 0.375519541; 0.376115439; 0.375519541; 0.376115439; 0.375519541; 0.376115439; 0.375519541; 0.376115439; NA | 5; 5; 10; 10; 3.33; 3.33; 3.33; 3.33; 6.25; 6.25; NA | −0.874141303 | −0.874141303 |
| 339 | 0.375519541; 0.376115439; NA | 6.9; 6.9; NA | −0.809068755 | −0.809068755 |
| 340 | 0.375519541; 0.376115439; NA | 6.9; 6.9; NA | −0.723853684 | −0.723853684 |
| 341 | NA | NA | −0.944150717 | −0.944150717 |
| 342 | NA | NA | −0.934437678 | −0.934437678 |
| 343 | 0.007721092; 0.376115439; NA | 100; 100; NA | −0.97589875 | −0.97589875 |
| 344 | 0.007721092; 0.376115439; NA | 100; 100; NA | −0.816938357 | −0.816938357 |
| 345 | 0.375519541; 0.376115439; NA | 3.33; 3.33; NA | −0.976072431 | −0.976072431 |
| 346 | 0.375519541; 0.376115439; NA | 3.33; 3.33; NA | −0.828664635 | −0.828664635 |
| 347 | 0.375519541; 0.376115439; NA | 2.63; 2.11; NA | −0.814276361 | −0.814276361 |
| 348 | 0.375519541; 0.376115439; NA | 2.63; 2.11; NA | −0.749839806 | −0.749839806 |
| 349 | 0.375519541; 0.376115439; NA | 1.22; 2.44; NA | −0.840481458 | −0.840481458 |
| 350 | 0.375519541; 0.376115439; NA | 1.22; 2.44; NA | −0.716930671 | −0.716930671 |
| 351 | 0.375519541; 0.376115439; NA | 5; 7.5; NA | −0.831695631 | −0.831695631 |
| 352 | 0.375519541; 0.376115439; NA | 5; 7.5; NA | −0.719687367 | −0.719687367 |
| 353 | 0.375519541; 0.376115439; NA | 2.29; 2.29; NA | −0.871100048 | −0.871100048 |
| 354 | 0.375519541; 0.376115439; NA | 2.29; 2.29; NA | −0.824196562 | −0.824196562 |
| 355 | 0.375519541; 0.376115439; 0.375519541; 0.376115439; 0.375519541; 0.376115439 | 6.25; 6.25; 12.5; 12.5; 10; 10 | −0.865767376 | −0.865767376 |
| 356 | 0.375519541; 0.376115439; 0.375519541; 0.376115439; 0.375519541; 0.376115439 | 6.25; 6.25; 12.5; 12.5; 10; 10 | −0.622209536 | −0.622209536 |
| 357 | 0.375519541; 0.376115439; 0.375519541; 0.376115439; 0.375519541; 0.376115439 | 2.08; 2.08; 6.67; 6.67; 2.33; 2.33 | −0.805969028 | −0.805969028 |
| 358 | 0.375519541; 0.376115439; 0.375519541; 0.376115439; 0.375519541; 0.376115439 | 2.08; 2.08; 6.67; 6.67; 2.33; 2.33 | −0.797581866 | −0.797581866 |
| 359 | 0.375519541; 0.376115439; NA | 2.44; 4.88; NA | −1.195123917 | −1.195123917 |
| 360 | 0.375519541; 0.376115439; NA | 2.44; 4.88; NA | −0.954148183 | −0.954148183 |
| 361 | 0.375519541; 0.376115439; NA | 4.35; 6.52; NA | −1.309738674 | −1.309738674 |
| 362 | 0.375519541; 0.376115439; NA | 4.35; 6.52; NA | −1.117933554 | −1.117933554 |
| 363 | 0.375519541; 0.376115439; 0.375519541; 0.376115439; 0.375519541; 0.376115439; NA | 4.17; 4.17; 0.66; 1.32; 1.19; 2.38; NA | −1.145854871 | −1.145854871 |
| 364 | 0.375519541; 0.376115439; 0.375519541; 0.376115439; 0.375519541; 0.376115439; NA | 4.17; 4.17; 0.66; 1.32; 1.19; 2.38; NA | −0.885683435 | −0.885683435 |
| 365 | 0.375519541; 0.376115439; NA | 5.26; 5.26; NA | −0.978351767 | −0.978351767 |
| 366 | 0.375519541; 0.376115439; NA | 5.26; 5.26; NA | −0.967332961 | −0.967332961 |
| 367 | 0.375519541; 0.376115439 | 13.64; 13.64 | −0.80694846 | −0.80694846 |
| 368 | 0.375519541; 0.376115439 | 13.64; 13.64 | −0.806365294 | −0.806365294 |
| 369 | 0.375519541; 0.376115439; NA | 4.88; 4.88; NA | −1.286450873 | −1.286450873 |
| 370 | 0.375519541; 0.376115439; NA | 4.88; 4.88; NA | −1.056178341 | −1.056178341 |
| 371 | 0.375519541; 0.376115439; 0.375519541; 0.376115439; 0.375519541; 0.376115439; NA | 2.7; 2.7; 4.55; 4.55; 1.92; 1.92; NA | −0.776863974 | −0.776863974 |
| 372 | 0.375519541; 0.376115439; 0.375519541; 0.376115439; 0.375519541; 0.376115439; NA | 2.7; 2.7; 4.55; 4.55; 1.92; 1.92; NA | −0.72733579 | −0.72733579 |
| 373 | 0.375519541; 0.376115439; NA | 11.43; 5.71; NA | −1.162595556 | −1.162595556 |
| 374 | 0.375519541; 0.376115439; NA | 11.43; 5.71; NA | −0.876533853 | −0.876533853 |
| 375 | 0.375519541; 0.376115439; NA | 2.7; 2.7; NA | −0.883635438 | −0.883635438 |
| 376 | 0.375519541; 0.376115439; NA | 2.7; 2.7; NA | −0.856646309 | −0.856646309 |
| 377 | 0.375519541; 0.376115439 | 7.69; 7.69 | −1.074105112 | −1.074105112 |
| 378 | 0.375519541; 0.376115439 | 7.69; 7.69 | −0.976511475 | −0.976511475 |
| 379 | NA | NA | −1.410088163 | −1.410088163 |
| 380 | NA | NA | −1.184443144 | −1.184443144 |
| 381 | 0.375519541; 0.376115439; NA | 16.67; 16.67; NA | −0.760380336 | −0.760380336 |
| 382 | 0.375519541; 0.376115439; NA | 16.67; 16.67; NA | −0.675157556 | −0.675157556 |
| 383 | 0.375519541; 0.376115439; NA | 2.96; 1.48; NA | −1.100687073 | −1.100687073 |
| 384 | 0.375519541; 0.376115439; NA | 2.96; 1.48; NA | −0.987623222 | −0.987623222 |
| 385 | 0.375519541; 0.376115439; NA | 6.9; 6.9; NA | −0.870794459 | −0.870794459 |
| 386 | 0.375519541; 0.376115439; NA | 6.9; 6.9; NA | −0.786934947 | −0.786934947 |
| 387 | 0.375519541; 0.376115439; NA | 5.56; 5.56; NA | −1.741773624 | −1.741773624 |
| 388 | 0.375519541; 0.376115439; NA | 5.56; 5.56; NA | −1.382282356 | −1.382282356 |
| 389 | 0.375519541; 0.376115439; NA | 4.17; 4.17; NA | −0.824477534 | −0.824477534 |
| 390 | 0.375519541; 0.376115439; NA | 4.17; 4.17; NA | −0.821261516 | −0.821261516 |

TABLE 3.d3-continued

| | FDR_HyperG | Percent_Sig | logFC | AveExpr |
|---|---|---|---|---|
| 391 | 0.375519541; 0.376115439; NA | 1.87; 2.8; NA | −1.391439553 | −1.391439553 |
| 392 | 0.375519541; 0.376115439; NA | 1.87; 2.8; NA | −1.383200123 | −1.383200123 |
| 393 | 0.375519541; 0.376115439; 0.375519541; 0.376115439; NA | 1.87; 2.8; 0.81; 0.81; NA | −1.132100408 | −1.132100408 |
| 394 | 0.375519541; 0.376115439; 0.375519541; 0.376115439; NA | 1.87; 2.8; 0.81; 0.81; NA | −0.824499671 | −0.824499671 |
| 395 | 0.375519541; 0.376115439; NA | 11.11; 11.11; NA | −0.761615774 | −0.761615774 |
| 396 | 0.375519541; 0.376115439; NA | 11.11; 11.11; NA | −0.739590554 | −0.739590554 |
| 397 | 0.375519541; 0.376115439; NA | 5.26; 5.26; NA | −0.886008175 | −0.886008175 |
| 398 | 0.375519541; 0.376115439; NA | 5.26; 5.26; NA | −0.883830596 | −0.883830596 |
| 399 | 0.375519541; 0.376115439; 0.375519541; 0.376115439; NA | 3.33; 3.33; 2.22; 4.44; NA | −0.860206751 | −0.860206751 |
| 400 | 0.375519541; 0.376115439; 0.375519541; 0.376115439; NA | 3.33; 3.33; 2.22; 4.44; NA | −0.793003257 | −0.793003257 |
| 401 | 0.375519541; 0.376115439; NA | 10; 10; NA | −1.454708376 | −1.454708376 |
| 402 | 0.375519541; 0.376115439; NA | 10; 10; NA | −1.35536412 | −1.35536412 |
| 403 | 0.375519541; 0.376115439; 0.375519541; 0.376115439; NA | 10; 10; 10; 10; NA | −1.212349306 | −1.212349306 |
| 404 | 0.375519541; 0.376115439; 0.375519541; 0.376115439; NA | 10; 10; 10; 10; NA | −0.977399348 | −0.977399348 |
| 405 | 0.375519541; 0.376115439; NA | 9.26; 11.11; NA | −0.830681206 | −0.830681206 |
| 406 | 0.375519541; 0.376115439; NA | 9.26; 11.11; NA | −0.779347846 | −0.779347846 |
| 407 | 0.375519541; 0.376115439; NA | 3.85; 3.85; NA | −0.954394932 | −0.954394932 |
| 408 | 0.375519541; 0.376115439; NA | 3.85; 3.85; NA | −0.737879777 | −0.737879777 |
| 409 | NA | NA | −0.764563519 | −0.764563519 |
| 410 | NA | NA | −0.719285274 | −0.719285274 |
| 411 | 0.375519541; 0.217379602; NA | 15.79; 21.05; NA | −0.923647913 | −0.923647913 |
| 412 | 0.375519541; 0.217379602; NA | 15.79; 21.05; NA | −0.818636244 | −0.818636244 |
| 413 | 0.375519541; 0.376115439; NA | 2.7; 5.41; NA | −0.792890284 | −0.792890284 |
| 414 | 0.375519541; 0.376115439; NA | 2.7; 5.41; NA | −0.669847039 | −0.669847039 |
| 415 | 0.375519541; 0.376115439; 0.375519541; 0.376115439 | 5.36; 3.57; 6; 6 | −0.707394345 | −0.707394345 |
| 416 | 0.375519541; 0.376115439; 0.375519541; 0.376115439 | 5.36; 3.57; 6; 6 | −0.636098161 | −0.636098161 |
| 417 | NA | NA | −0.75301095 | −0.75301095 |
| 418 | NA | NA | −0.750437096 | −0.750437096 |
| 419 | 0.375519541; 0.376115439; NA | 17.65; 11.76; NA | −1.246894747 | −1.246894747 |
| 420 | 0.375519541; 0.376115439; NA | 17.65; 11.76; NA | −1.140655166 | −1.140655166 |
| 421 | NA | NA | −0.768554446 | −0.768554446 |
| 422 | NA | NA | −0.726264736 | −0.726264736 |
| 423 | NA | NA | −0.754625968 | −0.754625968 |
| 424 | NA | NA | −0.749243708 | −0.749243708 |
| 425 | 0.375519541; 0.376115439; NA | 2.38; 2.38; NA | −0.926870051 | −0.926870051 |
| 426 | 0.375519541; 0.376115439; NA | 2.38; 2.38; NA | −0.789545602 | −0.789545602 |
| 427 | 0.375519541; 0.376115439; 0.375519541; 0.376115439 | 11.11; 11.11; 11.11; 11.11 | −0.863538231 | −0.863538231 |
| 428 | 0.375519541; 0.376115439; 0.375519541; 0.376115439 | 11.11; 11.11; 11.11; 11.11 | −0.782442469 | −0.782442469 |
| 429 | 0.375519541; 0.376115439; NA | 16.67; 16.67; NA | −1.306917223 | −1.306917223 |
| 430 | 0.375519541; 0.376115439; NA | 16.67; 16.67; NA | −0.885477066 | −0.885477066 |
| 431 | 0.242080288; 0.077749847; NA | 20; 25; NA | −1.383039898 | −1.383039898 |
| 432 | 0.242080288; 0.077749847; NA | 20; 25; NA | −1.192345027 | −1.192345027 |
| 433 | 0.375519541; 0.376115439; NA | 11.11; 11.11; NA | −0.866014897 | −0.866014897 |
| 434 | 0.375519541; 0.376115439; NA | 11.11; 11.11; NA | −0.700156781 | −0.700156781 |
| 435 | 0.375519541; 0.376115439; NA | 11.11; 11.11; NA | −1.094031267 | −1.094031267 |
| 436 | 0.375519541; 0.376115439; NA | 11.11; 11.11; NA | −0.954751365 | −0.954751365 |

TABLE 3.d4

| | T | P.Value | adj.P.Val | B | FC | FC_1 | LS |
|---|---|---|---|---|---|---|---|
| 331 | −15.40305266 | 0.00000000293 | 0.00000154 | 11.81530228 | 0.527953437 | −1.89410643 | −1 |
| 332 | −9.366959157 | 0.000000753 | 0.0000625 | 6.340097273 | 0.604721364 | −1.653654161 | −1 |
| 333 | −7.924499048 | 0.00000418 | 0.0000985 | 4.535830888 | 0.518320957 | −1.929306515 | −1 |
| 334 | −7.327723864 | 0.00000941 | 0.000304305 | 3.770550192 | 0.594523527 | −1.682019223 | −1 |
| 335 | −8.423915076 | 0.00000229 | 0.000124302 | 5.213300034 | 0.55444092 | −1.803618681 | −1 |
| 336 | −8.797860483 | 0.00000142 | 0.0000498 | 5.647316199 | 0.573945505 | −1.742325693 | −1 |
| 337 | −14.86078107 | 0.00000000441 | 0.00000191 | 11.42163634 | 0.513752815 | −1.946461354 | −1 |
| 338 | −9.012447513 | 0.00000113 | 0.00008 | 5.928125513 | 0.5455785 | −1.832916804 | −1 |
| 339 | −10.88034667 | 0.000000145 | 0.0000123 | 7.968195835 | 0.570750153 | −1.752080127 | −1 |
| 340 | −8.462664777 | 0.00000218 | 0.000121119 | 5.261594474 | 0.605477945 | −1.65158782 | −1 |
| 341 | −14.83737478 | 0.00000000470 | 0.00000381 | 11.31305836 | 0.519735418 | −1.924055903 | −1 |
| 342 | −9.75105331 | 0.000000476 | 0.0000252 | 6.763029365 | 0.523246377 | −1.911145579 | −1 |
| 343 | −9.350813197 | 0.000000767 | 0.0000633 | 6.3216273 | 0.508423017 | −1.966866107 | −1 |
| 344 | −7.238276016 | 0.0000104 | 0.000178447 | 3.596646223 | 0.567645305 | −1.761663475 | −1 |

TABLE 3.d4-continued

| | T | P.Value | adj.P.Val | B | FC | FC_1 | LS |
|---|---|---|---|---|---|---|---|
| 345 | −8.627381661 | 0.00000179 | 0.000106929 | 5.464920678 | 0.508361813 | −1.967102905 | −1 |
| 346 | −9.377568034 | 0.000000723 | 0.0000328 | 6.337279031 | 0.563050163 | −1.77604069 | −1 |
| 347 | −10.92714789 | 0.000000138 | 0.0000119 | 8.01564252 | 0.568693665 | −1.75841593 | −1 |
| 348 | −11.66749678 | 0.0000000697 | 0.0000149 | 8.714938486 | 0.594669585 | −1.681606098 | −1 |
| 349 | −6.725119536 | 0.0000218 | 0.000527416 | 2.91058998 | 0.558457169 | −1.790647619 | −1 |
| 350 | −8.417963034 | 0.00000225 | 0.0000664 | 5.174881341 | 0.608390415 | −1.643681386 | −1 |
| 351 | −7.798126044 | 0.00000493 | 0.000109597 | 4.367383638 | 0.561868478 | −1.779775943 | −1 |
| 352 | −6.458094521 | 0.000032 | 0.000679711 | 2.513485908 | 0.607229015 | −1.646825127 | −1 |
| 353 | −9.317708714 | 0.000000773 | 0.0000341 | 6.267704571 | 0.546729813 | −1.829057016 | −1 |
| 354 | −5.765464828 | 0.0000913 | 0.001371991 | 1.436267598 | 0.564796651 | −1.770548743 | −1 |
| 355 | −6.610521224 | 0.0000252 | 0.000320602 | 2.682915278 | 0.548754444 | −1.822308703 | −1 |
| 356 | −6.447663022 | 0.0000325 | 0.000687266 | 2.497769064 | 0.649675166 | −1.53923076 | −1 |
| 357 | −10.00139577 | 0.000000374 | 0.0000406 | 7.044594598 | 0.571977766 | −1.748319707 | −1 |
| 358 | −6.56128376 | 0.000027 | 0.000335173 | 2.608960326 | 0.575312665 | −1.738185271 | −1 |
| 359 | −12.93839332 | 0.0000000212 | 0.00000424 | 9.889431513 | 0.436748933 | −2.289644976 | −1 |
| 360 | −5.539746777 | 0.000130349 | 0.001755359 | 1.070421991 | 0.51614625 | −1.937435367 | −1 |
| 361 | −9.124465847 | 0.000000966 | 0.0000393 | 6.040509148 | 0.403393943 | −2.478966326 | −1 |
| 362 | −8.113656673 | 0.00000337 | 0.000159 | 4.820149231 | 0.460753314 | −2.170358781 | −1 |
| 363 | −9.602174961 | 0.000000561 | 0.0000279 | 6.595022534 | 0.451921822 | −2.2127721 | −1 |
| 364 | −6.211434533 | 0.0000462 | 0.000864536 | 2.13771615 | 0.541231069 | −1.84763968 | −1 |
| 365 | −7.945343066 | 0.00000417 | 0.000181804 | 4.601958934 | 0.507559279 | −1.970213216 | −1 |
| 366 | −8.920526194 | 0.00000123 | 0.0000453 | 5.796368649 | 0.511450683 | −1.955222728 | −1 |
| 367 | −5.664222474 | 0.000105502 | 0.000859592 | 1.201847513 | 0.571589587 | −1.749507028 | −1 |
| 368 | −6.019381984 | 0.0000617 | 0.00105455 | 1.839131872 | 0.571820682 | −1.748799985 | −1 |
| 369 | −8.186336569 | 0.000003 | 0.0000795 | 4.878574428 | 0.409958315 | −2.439272393 | −1 |
| 370 | −8.391287289 | 0.00000238 | 0.000127589 | 5.172497759 | 0.480904276 | −2.079415905 | −1 |
| 371 | −5.802787464 | 0.0000849 | 0.000736707 | 1.426626085 | 0.583634077 | −1.713402352 | −1 |
| 372 | −6.840270684 | 0.0000185 | 0.000472936 | 3.078761597 | 0.604018319 | −1.655578926 | −1 |
| 373 | −8.389658931 | 0.00000233 | 0.000068 | 5.139014356 | 0.446708138 | −2.238598123 | −1 |
| 374 | −7.098993093 | 0.0000129 | 0.000370933 | 3.449949473 | 0.544674468 | −1.835959014 | −1 |
| 375 | −8.511476381 | 0.0000206 | 0.000117189 | 5.32211773 | 0.541999927 | −1.845018699 | −1 |
| 376 | −8.697227788 | 0.0000016 | 0.0000538 | 5.523777223 | 0.552234793 | −1.81082397 | −1 |
| 377 | −9.274493187 | 0.000000813 | 0.0000352 | 6.217240808 | 0.474965585 | −2.1054157 | −1 |
| 378 | −7.538755108 | 0.00000709 | 0.000252002 | 4.060177366 | 0.508207131 | −1.967701629 | −1 |
| 379 | −12.59563615 | 0.0000000286 | 0.00000499 | 9.591402294 | 0.376288691 | −2.657534025 | −1 |
| 380 | −8.007170567 | 0.00000385 | 0.000173555 | 4.682515277 | 0.439994335 | −2.272756532 | −1 |
| 381 | −6.261573955 | 0.0000421 | 0.000451254 | 2.151478857 | 0.59034068 | −1.693937136 | −1 |
| 382 | −7.06012912 | 0.0000136 | 0.000385073 | 3.394774996 | 0.626263822 | −1.596771145 | −1 |
| 383 | −13.29060371 | 0.0000000156 | 0.0000036 | 10.18738114 | 0.466294374 | −2.144568016 | −1 |
| 384 | −11.71837636 | 0.0000000664 | 0.0000146 | 8.762229559 | 0.504307916 | −1.982915531 | −1 |
| 385 | −8.699104077 | 0.0000016 | 0.0000538 | 5.526091072 | 0.546845633 | −1.828669629 | −1 |
| 386 | −6.987570347 | 0.000015 | 0.000411493 | 3.291214664 | 0.579574109 | −1.725404886 | −1 |
| 387 | −11.89064726 | 0.0000000544 | 0.00000695 | 8.951957865 | 0.299001862 | −3.344460773 | −1 |
| 388 | −8.148200887 | 0.00000322 | 0.000155051 | 4.86449863 | 0.383611438 | −2.606804438 | −1 |
| 389 | −9.939988583 | 0.000000387 | 0.000022 | 6.973059432 | 0.564686664 | −1.7708936 | −1 |
| 390 | −16.31897469 | 0.00000000159 | 0.00000231 | 12.32275984 | 0.565946853 | −1.766950368 | −1 |
| 391 | −14.73023458 | 0.00000000511 | 0.00000399 | 11.23554538 | 0.381184258 | −2.623403192 | −1 |
| 392 | −10.76685913 | 0.000000163 | 0.0000132 | 7.852351576 | 0.383367483 | −2.608463277 | −1 |
| 393 | −9.001437397 | 0.00000111 | 0.0000428 | 5.893772979 | 0.456250989 | −2.19177607 | −1 |
| 394 | −13.1266406 | 0.0000000188 | 0.00000773 | 9.994070622 | 0.564678 | −1.770920773 | −1 |
| 395 | −8.592262337 | 0.00000182 | 0.000058 | 5.39369419 | 0.589835363 | −1.695388345 | −1 |
| 396 | −5.636215916 | 0.000111856 | 0.001575755 | 1.227665611 | 0.598909302 | −1.6697019 | −1 |
| 397 | −7.442856385 | 0.00000788 | 0.000148151 | 3.882997345 | 0.541109256 | −1.848055617 | −1 |
| 398 | −6.5146902 | 0.0000295 | 0.000643701 | 2.598489023 | 0.541926614 | −1.845268298 | −1 |
| 399 | −9.313121571 | 0.000000778 | 0.0000342 | 6.262357406 | 0.550873607 | −1.81529844 | −1 |
| 400 | −8.951860382 | 0.00000122 | 0.000084 | 5.856304062 | 0.577141406 | −1.732677624 | −1 |
| 401 | −19.21058447 | 0.000000000242 | 0.00000103 | 14.00538346 | 0.364828824 | −2.741011491 | −1 |
| 402 | −10.35207487 | 0.000000249 | 0.000017 | 7.419189894 | 0.390836167 | −2.558616846 | −1 |
| 403 | −9.420559347 | 0.000000688 | 0.0000317 | 6.387016549 | 0.431565276 | −2.317146574 | −1 |
| 404 | −7.34927411 | 0.00000914 | 0.000299369 | 3.800395741 | 0.507894463 | −1.968912977 | −1 |
| 405 | −8.135101066 | 0.00000328 | 0.000156625 | 4.847697669 | 0.562263692 | −1.778524941 | −1 |
| 406 | −7.167978811 | 0.0000115 | 0.000189997 | 3.496974511 | 0.582630105 | −1.716354838 | −1 |
| 407 | −5.647095069 | 0.000108398 | 0.000876327 | 1.173875764 | 0.51605798 | −1.937766762 | −1 |
| 408 | −9.948646591 | 0.000000396 | 0.0000421 | 6.987562272 | 0.599619922 | −1.667723107 | −1 |
| 409 | −6.678889502 | 0.0000232 | 0.000549313 | 2.842554814 | 0.588631429 | −1.698855939 | −1 |
| 410 | −8.798340421 | 0.00000142 | 0.0000498 | 5.64790265 | 0.607398279 | −1.646366205 | −1 |
| 411 | −9.633171566 | 0.000000542 | 0.0000273 | 6.630186096 | 0.527174352 | −1.896905637 | −1 |
| 412 | −7.625820949 | 0.00000632 | 0.000234604 | 4.177973912 | 0.566977644 | −1.763737971 | −1 |
| 413 | −8.328467386 | 0.00000251 | 0.0000711 | 5.061149746 | 0.577186602 | −1.732541949 | −1 |
| 414 | −7.372989295 | 0.00000885 | 0.000292859 | 3.833168439 | 0.628573328 | −1.590904283 | −1 |
| 415 | −8.376149411 | 0.00000237 | 0.0000687 | 5.121861864 | 0.612425243 | −1.632852353 | −1 |
| 416 | −8.494173232 | 0.0000021 | 0.000118596 | 5.300733663 | 0.643450842 | −1.554120277 | −1 |
| 417 | −10.81838874 | 0.0000016 | 0.0000245 | 7.894287104 | 0.593363895 | −1.68530645 | −1 |
| 418 | −6.573551886 | 0.0000266 | 0.000331965 | 2.627418687 | 0.594423437 | −1.682302443 | −1 |
| 419 | −9.78105613 | 0.00000046 | 0.0000246 | 6.796617881 | 0.421354154 | −2.373300444 | −1 |
| 420 | −9.48944746 | 0.000000656 | 0.0000573 | 6.479323239 | 0.45355356 | −2.204811267 | −1 |
| 421 | −5.906497953 | 0.0000723 | 0.000659575 | 1.593088987 | 0.587005348 | −1.703561991 | −1 |
| 422 | −8.231092072 | 0.00000291 | 0.000144892 | 4.970325116 | 0.604466908 | −1.654350284 | −1 |

TABLE 3.d4-continued

|  | T | P.Value | adj.P.Val | B | FC | FC_1 | LS |
|---|---|---|---|---|---|---|---|
| 423 | −11.95634939 | 0.0000000532 | 0.0000131 | 8.980718944 | 0.592700028 | −1.687194115 | −1 |
| 424 | −10.07876027 | 0.000000333 | 0.0000202 | 7.12510324 | 0.594915343 | −1.680911429 | −1 |
| 425 | −13.1013229 | 0.0000000192 | 0.0000078 | 9.973166353 | 0.525998266 | −1.901146952 | −1 |
| 426 | −16.0269123 | 0.00000000186 | 0.00000125 | 12.24943861 | 0.578526279 | −1.728529951 | −1 |
| 427 | −9.498218589 | 0.00000063 | 0.0000299 | 6.476375657 | 0.549602994 | −1.819495182 | −1 |
| 428 | −7.87680822 | 0.00000456 | 0.000192251 | 4.512105855 | 0.581381686 | −1.720040421 | −1 |
| 429 | −7.749405893 | 0.00000525 | 0.000114307 | 4.301908322 | 0.404183624 | −2.474122996 | −1 |
| 430 | −4.649862578 | 0.000568463 | 0.004918258 | −0.440168038 | 0.541308495 | −1.847375405 | −1 |
| 431 | −8.641616342 | 0.00000171 | 0.0000561 | 5.45501507 | 0.383410062 | −2.608173598 | −1 |
| 432 | −7.56693837 | 0.00000683 | 0.000246294 | 4.098415764 | 0.437591 | −2.285238954 | −1 |
| 433 | −5.474015475 | 0.000142842 | 0.001066198 | 0.888902787 | 0.548660304 | −1.822621381 | −1 |
| 434 | −7.171450122 | 0.0000116 | 0.000347783 | 3.552269482 | 0.615505315 | −1.624681341 | −1 |
| 435 | −5.093577314 | 0.000265883 | 0.001674094 | 0.247995619 | 0.468450571 | −2.134696939 | −1 |
| 436 | −10.00240574 | 0.000000374 | 0.0000405 | 7.045683917 | 0.515930498 | −1.938245566 | −1 |

TABLE 3 .d5

|  | Loop Detected | Probe sequence 60 mer | Probe Location Chr |
|---|---|---|---|
| 331 | sAD | ATCAGGTCATATATCTCACAGAGAACATTCGACCATGAGCTCTCTGATACCTACGGTTGT (SEQ ID NO: 2564) | 1 |
| 332 | mAD | ATCAGGTCATATATCTCACAGAGAACATTCGACCATGAGCTCTCTGATACCTACGGTTGT (SEQ ID NO: 2564) | 1 |
| 333 | sAD | AAAATAGCTACCTATGTAATAGAGAACATCGAAAATGGGTTCTGTTTCAAATACATGGAA (SEQ ID NO: 2566) | 14 |
| 334 | mAD | AAAATAGCTACCTATGTAATAGAGAACATCGAAAATGGGTTCTGTTTCAAATACATGGAA (SEQ ID NO: 2566) | 14 |
| 335 | mAD | TTTTTAAAGAAGGTTTGTATCATATTTCTCGAAGAGTGGCATGCTTTTCCCAAATGTCAC (SEQ ID NO: 2320) | 19 |
| 336 | sAD | TTTTTAAAGAAGGTTTGTATCATATTTCTCGAAGAGTGGCATGCTTTTCCCAAATGTCAC (SEQ ID NO: 2320) | 19 |
| 337 | sAD | ACATATACACTCATTCTCAAAATCTTTCTCGACTGAATTGGAATACATATACATGCAGGT (SEQ ID NO: 2570) | 20 |
| 338 | mAD | ACATATACACTCATTCTCAAAATCTTTCTCGACTGAATTGGAATACATATACATGCAGGT (SEQ ID NO: 2570) | 20 |
| 339 | sAD | TAAACTATCTGTTACCAGTCCGTCTCTTTCGAAATATGAATCATCTTTGTCCAGTATGGA (SEQ ID NO: 2572) | 13 |
| 340 | mAD | TAAACTATCTGTTACCAGTCCGTCTCTTTCGAAATATGAATCATCTTTGTCCAGTATGGA (SEQ ID NO: 2572) | 13 |
| 341 | mAD | GAAAAAATAGTTATGGAAGTTGAGAACATCGAAAATAAAGACCGAAAGAAATGAGGATAT (SEQ ID NO: 2574) | 6 |
| 342 | sAD | GAAAAAATAGTTATGGAAGTTGAGAACATCGAAAATAAAGACCGAAAGAAATGAGGATAT (SEQ ID NO: 2574) | 6 |
| 343 | mAD | ATATTTTACAATTTTTTAGGTCAAGAATTCGATTTGCTATTTGGAGAGCAATGAAACTGA (SEQ ID NO: 2576) | X |
| 344 | sAD | ATATTTTACAATTTTTTAGGTCAAGAATTCGATTTGCTATTTGGAGAGCAATGAAACTGA (SEQ ID NO: 2576) | X |
| 345 | mAD | TATTACAGAAAAAAAAAAATGGATCTCTTCGAAGCATGTATAATTTATTTTAGGAATATG (SEQ ID NO: 2578) | 5 |
| 346 | sAD | TATTACAGAAAAAAAAAAATGGATCTCTTCGAAGCATGTATAATTTATTTTAGGAATATG (SEQ ID NO: 2578) | 5 |
| 347 | sAD | ATGTATTTTTCACAATATGAATTAAAAGTCGATGTTTCAAGTTATGTCATAGGATTTCAA (SEQ ID NO: 2580) | 10 |
| 348 | mAD | ATGTATTTTTCACAATATGAATTAAAAGTCGATGTTTCAAGTTATGTCATAGGATTTCAA (SEQ ID NO: 2580) | 10 |

TABLE 3.d5-continued

| | Loop Detected | Probe sequence 60 mer | Probe Location Chr |
|---|---|---|---|
| 349 | mAD | TTTTCTTTTAAAGGGGAAAATGACAAACTCGAACTTCCTGAATATTTCTGTGATTTAAAT (SEQ ID NO: 2582) | 18 |
| 350 | sAD | TTTTCTTTTAAAGGGGAAAATGACAAACTCGAACTTCCTGAATATTTCTGTGATTTAAAT (SEQ ID NO: 2582) | 18 |
| 351 | sAD | CGTAATAGTTTGATAATTTTATTACTACTCGAGCAAAAGCTTACTTTTTCAGAAAAGAAA (SEQ ID NO: 2584) | 2 |
| 352 | mAD | CGTAATAGTTTGATAATTTTATTACTACTCGAGCAAAAGCTTACTTTTTCAGAAAAGAAA (SEQ ID NO: 2584) | 2 |
| 353 | sAD | GCACTTGTGCACTTACAATCTCCTGTCTTCGAACAGAAATTCCTTTTCATATTTTCAAAA (SEQ ID NO: 2586) | 20 |
| 354 | mAD | GCACTTGTGCACTTACAATCTCCTGTCTTCGAACAGAAATTCCTTTTCATATTTTCAAAA (SEQ ID NO: 2586) | 20 |
| 355 | sAD | TTCATTCTTTATAAACAGGATAAAACAGTCGAAGGAATTCATACCTAGTGACAGACAAGC (SEQ ID NO: 2588) | 21 |
| 356 | mAD | TTCATTCTTTATAAACAGGATAAAACAGTCGAAGGAATTCATACCTAGTGACAGACAAGC (SEQ ID NO: 2588) | 21 |
| 357 | mAD | ACAGAATTATGAAAAAAAAAAAACAAATTCGAATCCTGTTGGAGACATGATGTCATCCCC (SEQ ID NO: 2590) | 3 |
| 358 | sAD | ACAGAATTATGAAAAAAAAAAAACAAATTCGAATCCTGTTGGAGACATGATGTCATCCCC (SEQ ID NO: 2590) | 3 |
| 359 | sAD | GCATTITTATGAAATTAAATGTCCGTATTCGATTCTCAACCTCTTGCTTAGGTACACACA (SEQ ID NO: 2592) | 3 |
| 360 | mAD | GCATTTTTTATGAAATTAAATGTCCGTATTCGATTCTCAACCTCTTGCTTAGGTACACACA (SEQ ID NO: 2592) | 3 |
| 361 | sAD | TGGAATTTTAGATGGAAATTTAATAACTTCGAAAACTAAAACTGGATCCCTATCTCAGGC (SEQ ID NO: 2594) | 6 |
| 362 | mAD | TGGAATTTTAGATGGAAATTTAATAACTTCGAAAACTAAAACTGGATCCCTATCTCAGGC (SEQ ID NO: 2594) | 6 |
| 363 | sAD | AAAACAATTAACAATGAACACGGGAATATCGAGTAGAGTATAAAGGATTTGTGGGAAATA (SEQ ID NO: 2596) | 3 |
| 364 | mAD | AAAACAATTAACAATGAACACGGGAATATCGAGTAGAGTATAAAGGATTTGTGGGAAATA (SEQ ID NO: 2596) | 3 |
| 365 | mAD | ATGAAATAGTGTAATAGAGAAACTTTAGTCGAGTAACGCTGACTTCCTCTGAGTCTCTCC (SEQ ID NO: 2598) | 4 |
| 366 | sAD | ATGAAATAGTGTAATAGAGAAACTTTAGTCGAGTAACGCTGACTTCCTCTGAGTCTCTCC (SEQ ID NO: 2598) | 4 |
| 367 | sAD | GAGCCAATACAATAAATATTTTTTTAAGTCGAAGATAGATATAGACACCCTGTACTGTTT (SEQ ID NO: 2600) | 11 |
| 368 | mAD | GAGCCAATACAATAAATATTTTTTTAAGTCGAAGATAGATATAGACACCCTGTACTGTTT (SEQ ID NO: 2600) | 11 |
| 369 | sAD | GTTAAGAGGTTTTAAAAATAGAAACACATCGAGAAATGATAGAGAGGTTACTAGGAAAGT (SEQ ID NO: 2602) | 1 |
| 370 | mAD | GTTAAGAGGTTTTAAAAATAGAAACACATCGAGAAATGATAGAGAGGTTACTAGGAAAGT (SEQ ID NO: 2602) | 1 |
| 371 | sAD | TAAATAAATAAGTATAAAAATAAATCAATCGAGAGCCAGATATTTTTGTAGTTTTTATGC (SEQ ID NO: 2604) | 15 |
| 372 | mAD | TAAATAAATAAGTATAAAAATAAATCAATCGAGAGCCAGATATTTTTGTAGTTTTTATGC (SEQ ID NO: 2604) | 15 |
| 373 | sAD | CATTACATTTCATAATTTTCTGAAACCCTCGAGAAATGTTCCTTTATATAAGAAAAGCGA (SEQ ID NO: 2606) | 2 |
| 374 | mAD | CATTACATTTCATAATTTTCTGAAACCCTCGAGAAATGTTCCTTTATATAAGAAAAGCGA | 2 |

TABLE 3.d5-continued

| Loop Detected | Probe sequence 60 mer | Probe Location Chr |
|---|---|---|
| | (SEQ ID NO: 2606) | |
| 375 mAD | AGTTTTTTAATCTTTCCATTTTTTCTTTTCGACTGTCACCAGTATCATCCCTTCACTTTC (SEQ ID NO: 2608) | 21 |
| 376 sAD | AGTTTTTTAATCTTTCCATTTTTTCTTTTCGACTGTCACCAGTATCATCCCTTCACTTTC (SEQ ID NO: 2608) | 21 |
| 377 sAD | ATTTCAAGAGAGATATGCTAACCCTATTTCGATGTACCATTCCTTCCCTACTCTGAATGT (SEQ ID NO: 2610) | Y |
| 378 mAD | ATTTCAAGAGAGATATGCTAACCCTATTTCGATGTACCATTCCTTCCCTACTCTGAATGT (SEQ ID NO: 2610) | Y |
| 379 sAD | CAAGAAGAAGGGATAAAATACTACTTCTTCGATCAAAGGAAAAAGAAAGAAACCAAACCT (SEQ ID NO: 2612) | 2 |
| 380 mAD | CAAGAAGAAGGGATAAAATACTACTTCTTCGATCAAAGGAAAAAGAAAGAAACCAAACCT (SEQ ID NO: 2612) | 2 |
| 381 sAD | TGAAGGTTAGATTTTCTTAATAACATTTTCGATTACTGAAGAGTCCATTAGAGTAAGCAG (SEQ ID NO: 2614) | 6 |
| 382 mAD | TGAAGGTTAGATTTTCTTAATAACATTTTCGATTACTGAAGAGTCCATTAGAGTAAGCAG (SEQ ID NO: 2614) | 6 |
| 383 sAD | GTCTTTAGTTAGTAACTTTTCTGGCATATCGAAGTTCAAATATGATGTCCCTCTGAGCCT (SEQ ID NO: 2616) | 7 |
| 384 mAD | GTCTTTAGTTAGTAACTTTTCTGGCATATCGAAGTTCAAATATGATGTCCCTCTGAGCCT (SEQ ID NO: 2616) | 7 |
| 385 sAD | TTTTATGAAAGAGAGTGGATTTTTTTTTTCGAAATGGAAAGTAGGTTTGGGTTCATCTCT (SEQ ID NO: 2618) | 8 |
| 386 mAD | TTTTATGAAAGAGAGTGGATTTTTTTTTTCGAAATGGAAAGTAGGTTTGGGTTCATCTCT (SEQ ID NO: 2618) | 8 |
| 387 sAD | TCTTTTTTAGACAACTGTTTATTAGCAGTCGAGGGATATTTATTAATTATATTCTAAATC (SEQ ID NO: 2620) | 11 |
| 388 mAD | TCTTTTTTAGACAACTGTTTATTAGCAGTCGAGGGATATTTATTAATTATATTCTAAATC (SEQ ID NO: 2620) | 11 |
| 389 sAD | ACTTATCTTTCCAACTTTTATTTTGGATTCGAGTTTCCTTTAATCCCAAAGACACTTGGG (SEQ ID NO: 2622) | 9 |
| 390 mAD | ACTTATCTTTCCAACTTTTATTTTGGATTCGAGTTTCCTTTAATCCCAAAGACACTTGGG (SEQ ID NO: 2622) | 9 |
| 391 mAD | GAAAAATCCATGGTAATGAATTAGTTTCTCGAAATACTTTTTCTATACTATGGACAACAA (SEQ ID NO: 2624) | 1 |
| 392 sAD | GAAAAATCCATGGTAATGAATTAGTTTCTCGAAATACTTTTTCTATACTATGGACAACAA (SEQ ID NO: 2624) | 1 |
| 393 sAD | AGATAGCCTTTAAAGTAGCTCTAATATTTCGAAGACATACTTCTCTGAAAATACTTATTG (SEQ ID NO: 2626) | 1 |
| 394 mAD | AGATAGCCTTTAAAGTAGCTCTAATATTTCGAAGACATACTTCTCTGAAAATACTTATTG (SEQ ID NO: 2626) | 1 |
| 395 sAD | AACCTCTTGGCATTTCTCTTATCAAGATTCGAAAGAAAGAGAAGTGAAAGTCTCTCTTTG (SEQ ID NO: 2628) | 1 |
| 396 mAD | AACCTCTTGGCATTTCTCTTATCAAGATTCGAAAGAAAGAGAAGTGAAAGTCTCTCTTTG (SEQ ID NO: 2628) | 1 |
| 397 sAD | TATTGAGTTTTAAGTGTTTTGTATATTTTCGATACTGGGTTCAAATCTCAATTTTATTTT (SEQ ID NO: 1113) | 10 |
| 398 mAD | TATTGAGTTTTAAGTGTTTTGTATATTTTCGATACTGGGTTCAAATCTCAATTTTATTTT (SEQ ID NO: 1113) | 10 |
| 399 sAD | CAATTAATTACATTTTGTTCAATGAAATTCGATTATGTCACATGTAACATGAGTGATTCC (SEQ ID NO: 2632) | 15 |

TABLE 3.d5-continued

| | Loop Detected | Probe sequence 60 mer | Probe Location Chr |
|---|---|---|---|
| 400 | mAD | CAATTAATTACATTTTGTTCAATGAAATTCGATTATGTCACATGTAACATGAGTGATTCC (SEQ ID NO: 2632) | 15 |
| 401 | mAD | TAACTACACTAAATATTGAACACAAAAATCGATAAGAAGTTACTTCAACAGCTTCAGAAG (SEQ ID NO: 2634) | 18 |
| 402 | sAD | TAACTACACTAAATATTGAACACAAAAATCGATAAGAAGTTACTTCAACAGCTTCAGAAG (SEQ ID NO: 2634) | 18 |
| 403 | sAD | AAAAAACTATCTTATACTCCTCACTTCTTCGAATTCTATATTCCCCATTTAAAAGACTAC (SEQ ID NO: 2636) | 2 |
| 404 | mAD | AAAAAACTATCTTATACTCCTCACTTCTTCGAATTCTATATTCCCCATTTAAAAGACTAC (SEQ ID NO: 2636) | 2 |
| 405 | mAD | TAAATAGACTGGAAGTGCTTGAAGCACTTCGAACAAATCCTTTTCACCCATTAATCAAGA (SEQ ID NO: 2638) | 2 |
| 406 | sAD | TAAATAGACTGGAAGTGCTTGAAGCACTTCGAACAAATCCTTTTCACCCATTAATCAAGA (SEQ ID NO: 2638) | 2 |
| 407 | sAD | TCTATATATTCTTTTCTTCCTCTTAAAATCGATATGAACCTGAGATGGAAGTTCCTGGAG (SEQ ID NO: 2640) | 2 |
| 408 | mAD | TCTATATATTCTTTTCTTCCTCTTAAAATCGATATGAACCTGAGATGGAAGTTCCTGGAG (SEQ ID NO: 2640) | 2 |
| 409 | mAD | TGTCATTTTTGTGACAGCAAATTCATCTTCGACTGTGAAAGACGTGGAAGTATTTTTCTC (SEQ ID NO: 2642) | 20 |
| 410 | sAD | TGTCATTTTTGTGACAGCAAATTCATCTTCGACTGTGAAAGACGTGGAAGTATTTTTCTC (SEQ ID NO: 2642) | 20 |
| 411 | sAD | TTTTGAACACATTTTTAAAACTCTGAGTTCGATCATAAGACTTGAAAGTTTAGATTACTC (SEQ ID NO: 2644) | 4 |
| 412 | mAD | TTTTGAACACATTTTTAAAACTCTGAGTTCGATCATAAGACTTGAAAGTTTAGATTACTC (SEQ ID NO: 2644) | 4 |
| 413 | sAD | CCAGTTACATAAAGAAAGGAAAAATGGATCGATGAGTCTTTTTTATTTTGAGACAGGGTC (SEQ ID NO: 2646) | 6 |
| 414 | mAD | CCAGTTACATAAAGAAAGGAAAAATGGATCGATGAGTCTTTTTTATTTTGAGACAGGGTC (SEQ ID NO: 2646) | 6 |
| 415 | sAD | GCTATTCAAATAAACATGTATTCCTCATTCGACCTTCAGAAGCTCTGGTTTCATCATCCA (SEQ ID NO: 2648) | 13 |
| 416 | mAD | GCTATTCAAATAAACATGTATTCCTCATTCGACCTTCAGAAGCTCTGGTTTCATCATCCA (SEQ ID NO: 2648) | 13 |
| 417 | mAD | ACGTTTTAATATCTCAAGATTATGAGATTCGAAAGCTCTTCTAGATAGTTGTTATTGGCT (SEQ ID NO: 2650) | 13 |
| 418 | sAD | ACGTTTTAATATCTCAAGATTATGAGATTCGAAAGCTCTTCTAGATAGTTGTTATTGGCT (SEQ ID NO: 2650) | 13 |
| 419 | sAD | ACACTGAGAAACACTCATTGAAGTTAACTCGATAGAGTTAAATACATTTTGGTTGGATGG (SEQ ID NO: 2652) | 1 |
| 420 | mAD | ACACTGAGAAACACTCATTGAAGTTAACTCGATAGAGTTAAATACATTTTGGTTGGATGG (SEQ ID NO: 2652) | 1 |
| 421 | sAD | GTCTTGTTAATCTGAATGTTATATGCATTCGAAAGCTCTTCTAGATAGTTGTTATTGGCT (SEQ ID NO: 2654) | 13 |
| 422 | mAD | GTCTTGTTAATCTGAATGTTATATGCATTCGAAAGCTCTTCTAGATAGTTGTTATTGGCT (SEQ ID NO: 2654) | 13 |
| 423 | mAD | AGGAGTTAATTAGCCAAAGGGAAAACAATCGAAGATTGTTGCTGAGAAAAGTCAATATGA (SEQ ID NO: 2656) | 2 |
| 424 | sAD | AGGAGTTAATTAGCCAAAGGGAAAACAATCGAAGATTGTTGCTGAGAAAAGTCAATATGA (SEQ ID NO: 2656) | 2 |

TABLE 3.d5-continued

| | Loop Detected | Probe sequence 60 mer | Probe Location Chr |
|---|---|---|---|
| 425 | mAD | AAACTTATAACTTCTGCCAATTCTCCCTTCGAATATTTGCAAGGCAGGATTTTGTAATTA (SEQ ID NO: 2658) | 6 |
| 426 | sAD | AAACTTATAACTTCTGCCAATTCTCCCTTCGAATATTTGCAAGGCAGGATTTTGTAATTA (SEQ ID NO: 2658) | 6 |
| 427 | sAD | ACAATATATACTTGAAGAATATTGTCCTTCGAGTATGTCTTTATCAACGGCATGAGAACA (SEQ ID NO: 2660) | 9 |
| 428 | mAD | ACAATATATACTTGAAGAATATTGTCCTTCGAGTATGTCTTTATCAACGGCATGAGAACA (SEQ ID NO: 2660) | 9 |
| 429 | sAD | AATCAAGCTAATTAACACATTCATAACCTCGAATTTCTTTCCAACGAAGGAACTTGTGAA (SEQ ID NO: 2662) | 2 |
| 430 | mAD | AATCAAGCTAATTAACACATTCATAACCTCGAATTTCTTTCCAACGAAGGAACTTGTGAA (SEQ ID NO: 2662) | 2 |
| 431 | sAD | TGAGTGAATATAAATCACTAAAACATGTTCGAACAGGAAACGTCATAGAGAAAACTCAGC (SEQ ID NO: 2664) | 6 |
| 432 | mAD | TGAGTGAATATAAATCACTAAAACATGTTCGAACAGGAAACGTCATAGAGAAAACTCAGC (SEQ ID NO: 2664) | 6 |
| 433 | sAD | CCTTGTACTTACTGCTAGTCTTCTGTTATCGACAATTACTATCAAATGTCTATAACCATT (SEQ ID NO: 2666) | 7 |
| 434 | mAD | CCTTGTACTTACTGCTAGTCTTCTGTTATCGACAATTACTATCAAATGTCTATAACCATT (SEQ ID NO: 2666) | 7 |
| 435 | sAD | TTTTATTGCTTTTTAAAAGAGCTTGTCATCGAAGCTCCTTGTGGACAAGTAGATAATGTG (SEQ ID NO: 2668) | 8 |
| 436 | mAD | TTTTATTGCTTTTTAAAAGAGCTTGTCATCGAAGCTCCTTGTGGACAAGTAGATAATGTG (SEQ ID NO: 2668) | 8 |

TABLE 3.d6

| | Probe Location | | | | 4 kb Sequence Location | | | | |
|---|---|---|---|---|---|---|---|---|---|
| | Start1 | End1 | Start2 | End2 | Chr | Start1 | End1 | Start2 | End2 |
| 331 | 50024584 | 50024615 | 50103291 | 50103322 | 1 | 50024584 | 50028585 | 50099321 | 50103322 |
| 332 | 50024584 | 50024615 | 50103291 | 50103322 | 1 | 50024584 | 50028585 | 50099321 | 50103322 |
| 333 | 39721868 | 39721899 | 39792290 | 39792321 | 14 | 39721868 | 39725869 | 39792290 | 39796291 |
| 334 | 39721868 | 39721899 | 39792290 | 39792321 | 14 | 39721868 | 39725869 | 39792290 | 39796291 |
| 335 | 46481483 | 46481514 | 46545017 | 46545048 | 19 | 46477513 | 46481514 | 46541047 | 46545048 |
| 336 | 46481483 | 46481514 | 46545017 | 46545048 | 19 | 46477513 | 46481514 | 46541047 | 46545048 |
| 337 | 1283617 | 1283648 | 1344898 | 1344929 | 20 | 1283617 | 1287618 | 1340928 | 1344929 |
| 338 | 1283617 | 1283648 | 1344898 | 1344929 | 20 | 1283617 | 1287618 | 1340928 | 1344929 |
| 339 | 36613363 | 36613394 | 36670823 | 36670854 | 13 | 36609393 | 36613394 | 36670823 | 36674824 |
| 340 | 36613363 | 36613394 | 36670823 | 36670854 | 13 | 36609393 | 36613394 | 36670823 | 36674824 |
| 341 | 148168867 | 148168898 | 148224860 | 148224891 | 6 | 148168867 | 148172868 | 148220890 | 148224891 |
| 342 | 148168867 | 148168898 | 148224860 | 148224891 | 6 | 148168867 | 148172868 | 148220890 | 148224891 |
| 343 | 40505666 | 40505697 | 40520869 | 40520900 | X | 40505666 | 40509667 | 40520869 | 40524870 |
| 344 | 40505666 | 40505697 | 40520869 | 40520900 | X | 40505666 | 40509667 | 40520869 | 40524870 |
| 345 | 7542352 | 7542383 | 7555641 | 7555672 | 5 | 7538382 | 7542383 | 7555641 | 7559642 |
| 346 | 7542352 | 7542383 | 7555641 | 7555672 | 5 | 7538382 | 7542383 | 7555641 | 7559642 |
| 347 | 121570719 | 121570750 | 121595209 | 121595240 | 10 | 121566749 | 121570750 | 121595209 | 121599210 |
| 348 | 121570719 | 121570750 | 121595209 | 121595240 | 10 | 121566749 | 121570750 | 121595209 | 121599210 |
| 349 | 23859209 | 23859240 | 23887990 | 23888021 | 18 | 23859209 | 23863210 | 23887990 | 23891991 |
| 350 | 23859209 | 23859240 | 23887990 | 23888021 | 18 | 23859209 | 23863210 | 23887990 | 23891991 |
| 351 | 79981700 | 79981731 | 80037423 | 80037454 | 2 | 79981700 | 79985701 | 80033453 | 80037454 |
| 352 | 79981700 | 79981731 | 80037423 | 80037454 | 2 | 79981700 | 79985701 | 80033453 | 80037454 |
| 353 | 19885722 | 19885753 | 19898126 | 19898157 | 20 | 19885722 | 19889723 | 19898126 | 19902127 |
| 354 | 19885722 | 19885753 | 19898126 | 19898157 | 20 | 19885722 | 19889723 | 19898126 | 19902127 |
| 355 | 14555692 | 14555723 | 14600448 | 14600479 | 21 | 14551722 | 14555723 | 14596478 | 14600479 |
| 356 | 14555692 | 14555723 | 14600448 | 14600479 | 21 | 14551722 | 14555723 | 14596478 | 14600479 |
| 357 | 46491022 | 46491053 | 46536291 | 46536322 | 3 | 46487052 | 46491053 | 46532321 | 46536322 |
| 358 | 46491022 | 46491053 | 46536291 | 46536322 | 3 | 46487052 | 46491053 | 46532321 | 46536322 |
| 359 | 64195292 | 64195323 | 64266976 | 64267007 | 3 | 64191322 | 64195323 | 64266976 | 64270977 |
| 360 | 64195292 | 64195323 | 64266976 | 64267007 | 3 | 64191322 | 64195323 | 64266976 | 64270977 |
| 361 | 169230654 | 169230685 | 169286051 | 169286082 | 6 | 169230654 | 169234655 | 169286051 | 169290052 |

TABLE 3.d6-continued

| | Probe Location | | | | 4 kb Sequence Location | | | | |
|---|---|---|---|---|---|---|---|---|---|
| | Start1 | End1 | Start2 | End2 | Chr | Start1 | End1 | Start2 | End2 |
| 362 | 169230654 | 169230685 | 169286051 | 169286082 | 6 | 169230654 | 169234655 | 169286051 | 169290052 |
| 363 | 69108055 | 69108086 | 69217093 | 69217124 | 3 | 69108055 | 69112056 | 69213123 | 69217124 |
| 364 | 69108055 | 69108086 | 69217093 | 69217124 | 3 | 69108055 | 69112056 | 69213123 | 69217124 |
| 365 | 88335985 | 88336016 | 88412084 | 88412115 | 4 | 88335985 | 88339986 | 88412084 | 88416085 |
| 366 | 88335985 | 88336016 | 88412084 | 88412115 | 4 | 88335985 | 88339986 | 88412084 | 88416085 |
| 367 | 84860156 | 84860187 | 84918402 | 84918433 | 11 | 84860156 | 84864157 | 84918402 | 84922403 |
| 368 | 84860156 | 84860187 | 84918402 | 84918433 | 11 | 84860156 | 84864157 | 84918402 | 84922403 |
| 369 | 206385274 | 206385305 | 206449236 | 206449267 | 1 | 206381304 | 206385305 | 206445266 | 206449267 |
| 370 | 206385274 | 206385305 | 206449236 | 206449267 | 1 | 206381304 | 206385305 | 206445266 | 206449267 |
| 371 | 74123975 | 74124006 | 74179522 | 74179553 | 15 | 74120005 | 74124006 | 74175552 | 74179553 |
| 372 | 74123975 | 74124006 | 74179522 | 74179553 | 15 | 74120005 | 74124006 | 74175552 | 74179553 |
| 373 | 56277586 | 56277617 | 56329605 | 56329636 | 2 | 56273616 | 56277617 | 56325635 | 56329636 |
| 374 | 56277586 | 56277617 | 56329605 | 56329636 | 2 | 56273616 | 56277617 | 56325635 | 56329636 |
| 375 | 45838996 | 45839027 | 45851520 | 45851551 | 21 | 45835026 | 45839027 | 45847550 | 45851551 |
| 376 | 45838996 | 45839027 | 45851520 | 45851551 | 21 | 45835026 | 45839027 | 45847550 | 45851551 |
| 377 | 14474187 | 14474218 | 14520608 | 14520639 | Y | 14470217 | 14474218 | 14520608 | 14524609 |
| 378 | 14474187 | 14474218 | 14520608 | 14520639 | Y | 14470217 | 14474218 | 14520608 | 14524609 |
| 379 | 21331973 | 21332004 | 21374795 | 21374826 | 2 | 21328003 | 21332004 | 21374795 | 21378796 |
| 380 | 21331973 | 21332004 | 21374795 | 21374826 | 2 | 21328003 | 21332004 | 21374795 | 21378796 |
| 381 | 70128487 | 70128518 | 70190375 | 70190406 | 6 | 70128487 | 70132488 | 70186405 | 70190406 |
| 382 | 70128487 | 70128518 | 70190375 | 70190406 | 6 | 70128487 | 70132488 | 70186405 | 70190406 |
| 383 | 37211489 | 37211520 | 37233817 | 37233848 | 7 | 37211489 | 37215490 | 37229847 | 37233848 |
| 384 | 37211489 | 37211520 | 37233817 | 37233848 | 7 | 37211489 | 37215490 | 37229847 | 37233848 |
| 385 | 74044912 | 74044943 | 74079684 | 74079715 | 8 | 74044912 | 74048913 | 74075714 | 74079715 |
| 386 | 74044912 | 74044943 | 74079684 | 74079715 | 8 | 74044912 | 74048913 | 74075714 | 74079715 |
| 387 | 104895593 | 104895624 | 104915537 | 104915568 | 11 | 104895593 | 104899594 | 104915537 | 104919538 |
| 388 | 104895593 | 104895624 | 104915537 | 104915568 | 11 | 104895593 | 104899594 | 104915537 | 104919538 |
| 389 | 117491884 | 117491915 | 117513941 | 117513972 | 9 | 117491884 | 117495885 | 117513941 | 117517942 |
| 390 | 117491884 | 117491915 | 117513941 | 117513972 | 9 | 117491884 | 117495885 | 117513941 | 117517942 |
| 391 | 177028175 | 177028206 | 177116397 | 177116428 | 1 | 177028175 | 177032176 | 177116397 | 177120398 |
| 392 | 177028175 | 177028206 | 177116397 | 177116428 | 1 | 177028175 | 177032176 | 177116397 | 177120398 |
| 393 | 177133036 | 177133067 | 177178719 | 177178750 | 1 | 177129066 | 177133067 | 177178719 | 177182720 |
| 394 | 177133036 | 177133067 | 177178719 | 177178750 | 1 | 177129066 | 177133067 | 177178719 | 177182720 |
| 395 | 76032659 | 76032690 | 76083373 | 76083404 | 1 | 76032659 | 76036660 | 76083373 | 76087374 |
| 396 | 76032659 | 76032690 | 76083373 | 76083404 | 1 | 76032659 | 76036660 | 76083373 | 76087374 |
| 397 | 76419786 | 76419817 | 76444465 | 76444496 | 10 | 76415816 | 76419817 | 76444465 | 76448466 |
| 398 | 76419786 | 76419817 | 76444465 | 76444496 | 10 | 76415816 | 76419817 | 76444465 | 76448466 |
| 399 | 59205508 | 59205539 | 59259334 | 59259365 | 15 | 59205508 | 59209509 | 59259334 | 59263335 |
| 400 | 59205508 | 59205539 | 59259334 | 59259365 | 15 | 59205508 | 59209509 | 59259334 | 59263335 |
| 401 | 35655009 | 35655040 | 35676499 | 35676530 | 18 | 35655009 | 35659010 | 35676499 | 35680500 |
| 402 | 35655009 | 35655040 | 35676499 | 35676530 | 18 | 35655009 | 35659010 | 35676499 | 35680500 |
| 403 | 106160923 | 106160954 | 106222125 | 106222156 | 2 | 106156953 | 106160954 | 106218155 | 106222156 |
| 404 | 106160923 | 106160954 | 106222125 | 106222156 | 2 | 106156953 | 106160954 | 106218155 | 106222156 |
| 405 | 20263366 | 20263397 | 20369281 | 20369312 | 2 | 20259396 | 20263397 | 20365311 | 20369312 |
| 406 | 20263366 | 20263397 | 20369281 | 20369312 | 2 | 20259396 | 20263397 | 20365311 | 20369312 |
| 407 | 217551078 | 217551109 | 217605412 | 217605443 | 2 | 217551078 | 217555079 | 217605412 | 217609413 |
| 408 | 217551078 | 217551109 | 217605412 | 217605443 | 2 | 217551078 | 217555079 | 217605412 | 217609413 |
| 409 | 11127964 | 11127995 | 11191868 | 11191899 | 20 | 11123994 | 11127995 | 11191868 | 11195869 |
| 410 | 11127964 | 11127995 | 11191868 | 11191899 | 20 | 11123994 | 11127995 | 11191868 | 11195869 |
| 411 | 125343567 | 125343598 | 125382298 | 125382329 | 4 | 125339597 | 125343598 | 125382298 | 125386299 |
| 412 | 125343567 | 125343598 | 125382298 | 125382329 | 4 | 125339597 | 125343598 | 125382298 | 125386299 |
| 413 | 5723608 | 5723639 | 5745537 | 5745568 | 6 | 5723608 | 5727609 | 5745537 | 5749538 |
| 414 | 5723608 | 5723639 | 5745537 | 5745568 | 6 | 5723608 | 5727609 | 5745537 | 5749538 |
| 415 | 45859224 | 45859255 | 45923601 | 45923632 | 13 | 45859224 | 45863225 | 45923601 | 45927602 |
| 416 | 45859224 | 45859255 | 45923601 | 45923632 | 13 | 45859224 | 45863225 | 45923601 | 45927602 |
| 417 | 74451031 | 74451062 | 74472806 | 74472837 | 13 | 74447061 | 74451062 | 74472806 | 74476807 |
| 418 | 74451031 | 74451062 | 74472806 | 74472837 | 13 | 74447061 | 74451062 | 74472806 | 74476807 |
| 419 | 66151935 | 66151966 | 66218811 | 66218842 | 1 | 66147965 | 66151966 | 66218811 | 66222812 |
| 420 | 66151935 | 66151966 | 66218811 | 66218842 | 1 | 66147965 | 66151966 | 66218811 | 66222812 |
| 421 | 74472806 | 74472837 | 74514777 | 74514808 | 13 | 74472806 | 74476807 | 74510807 | 74514808 |
| 422 | 74472806 | 74472837 | 74514777 | 74514808 | 13 | 74472806 | 74476807 | 74510807 | 74514808 |
| 423 | 19641438 | 19641469 | 19664902 | 19664933 | 2 | 19641438 | 19645439 | 19660932 | 19664933 |
| 424 | 19641438 | 19641469 | 19664902 | 19664933 | 2 | 19641438 | 19645439 | 19660932 | 19664933 |
| 425 | 27449427 | 27449458 | 27518903 | 27518934 | 6 | 27445457 | 27449458 | 27514933 | 27518934 |
| 426 | 27449427 | 27449458 | 27518903 | 27518934 | 6 | 27445457 | 27449458 | 27514933 | 27518934 |
| 427 | 105415770 | 105415801 | 105443172 | 105443203 | 9 | 105411800 | 105415801 | 105439202 | 105443203 |
| 428 | 105415770 | 105415801 | 105443172 | 105443203 | 9 | 105411800 | 105415801 | 105439202 | 105443203 |
| 429 | 161568697 | 161568728 | 161587453 | 161587484 | 2 | 161568697 | 161572698 | 161583483 | 161587484 |
| 430 | 161568697 | 161568728 | 161587453 | 161587484 | 2 | 161568697 | 161572698 | 161583483 | 161587484 |
| 431 | 84687731 | 84687762 | 84786605 | 84786636 | 6 | 84687731 | 84691732 | 84782635 | 84786636 |
| 432 | 84687731 | 84687762 | 84786605 | 84786636 | 6 | 84687731 | 84691732 | 84782635 | 84786636 |
| 433 | 107254515 | 107254546 | 107284754 | 107284785 | 7 | 107250545 | 107254546 | 107284754 | 107288755 |
| 434 | 107254515 | 107254546 | 107284754 | 107284785 | 7 | 107250545 | 107254546 | 107284754 | 107288755 |
| 435 | 119154139 | 119154170 | 119209458 | 119209489 | 8 | 119154139 | 119158140 | 119209458 | 119213459 |
| 436 | 119154139 | 119154170 | 119209458 | 119209489 | 8 | 119154139 | 119158140 | 119209458 | 119213459 |

TABLE 3.d7

| | Probe | PCR-Primer1_ID | PCR_Primer1 |
|---|---|---|---|
| 331 | ORF175_1_50024584_50030848_50095924_50103322_RF | OBD159_2021 | GGCGATTTAGACAGGTTAGACATCCA (SEQ ID NO: 2670) |
| 332 | ORF175_1_50024584_50030848_50095924_50103322_RF | OBD159_2021 | GGCGATTTAGACAGGTTAGACATCCA (SEQ ID NO: 2670) |
| 333 | ORF176_14_39721868_39724679_39792290_39806170_RR | OBD159_2025 | TTATGAATGCTAACAAAGTGCTGT (SEQ ID NO: 2672) |
| 334 | ORF176_14_39721868_39724679_39792290_39806170_RR | OBD159_2025 | TTATGAATGCTAACAAAGTGCTGT (SEQ ID NO: 2672) |
| 335 | ORF176_19_46479838_46481514_46541191_46545048_FF | OBD159_1973 | GGTCTGAACACAGTCTTGGCTGG (SEQ ID NO: 2430) |
| 336 | ORF176_19_46479838_46481514_46541191_46545048_FF | OBD159_1973 | GGTCTGAACACAGTCTTGGCTGG (SEQ ID NO: 2430) |
| 337 | ORF176_20_1283617_1286683_1342450_1344929_RF | OBD159_2029 | CTTTTAGAAGAGAAATAGGAGATT (SEQ ID NO: 2676) |
| 338 | ORF176_20_1283617_1286683_1342450_1344929_RF | OBD159_2029 | CTTTTAGAAGAGAAATAGGAGATT (SEQ ID NO: 2676) |
| 339 | ORF177_13_36604370_36613394_36670823_36673255_FR | OBD159_2033 | TCTCTTTCCAGACACTGCTCGGCACT (SEQ ID NO: 2678) |
| 340 | ORF177_13_36604370_36613394_36670823_36673255_FR | OBD159_2033 | TCTCTTTCCAGACACTGCTCGGCACT (SEQ ID NO: 2678) |
| 341 | ORF177_6_148168867_148173481_148222776_148224891_RF | OBD159_2037 | GAATGAGTAATGAGATGGGAGATGGG (SEQ ID NO: 2680) |
| 342 | ORF177_6_148168867_148173481_148222776_148224891_RF | OBD159_2037 | GAATGAGTAATGAGATGGGAGATGGG (SEQ ID NO: 2680) |
| 343 | ORF177_X_40505666_40507827_40520869_40522158_RR | OBD159_2041 | CAAACTACTCTAATCCCAGGTGGCTA (SEQ ID NO: 2682) |
| 344 | ORF177_X_40505666_40507827_40520869_40522158_RR | OBD159_2041 | CAAACTACTCTAATCCCAGGTGGCTA (SEQ ID NO: 2682) |
| 345 | ORF179_5_7540900_7542383_7555641_7557907_FR | OBD159_2045 | AATCTGAACTTAGACAGGCTGGCTGC (SEQ ID NO: 1770) |
| 346 | ORF179_5_7540900_7542383_7555641_7557907_FR | OBD159_2045 | AATCTGAACTTAGACAGGCTGGCTGC (SEQ ID NO: 1770) |
| 347 | ORF18_10_121564423_121570750_121595209_121596934_FR | OBD159_2049 | CTCATCTCCTGCCAAAACGCAATGGG (SEQ ID NO: 2686) |
| 348 | ORF18_10_121564423_121570750_121595209_121596934_FR | OBD159_2049 | CTCATCTCCTGCCAAAACGCAATGGG (SEQ ID NO: 2686) |
| 349 | ORF18_18_23859209_23862260_23887990_23889494_RR | OBD159_2053 | CCTCCAGGTAGAGAGTGTCAGAAGTG (SEQ ID NO: 2688) |
| 350 | ORF18_18_23859209_23862260_23887990_23889494_RR | OBD159_2053 | CCTCCAGGTAGAGAGTGTCAGAAGTG (SEQ ID NO: 2688) |
| 351 | ORF18_2_79981700_79985274_80035781_80037454_RF | OBD159_2057 | TCCTCTGTTCTCAACTCGGTCTCAGT (SEQ ID NO: 2690) |
| 352 | ORF18_2_79981700_79985274_80035781_80037454_RF | OBD159_2057 | TCCTCTGTTCTCAACTCGGTCTCAGT (SEQ ID NO: 2690) |
| 353 | ORF18_20_19885722_19887043_19898126_19900554_RR | OBD159_2061 | TCCGCTCCTCTCCTCTTCTCTTA (SEQ ID NO: 2692) |
| 354 | ORF18_20_19885722_19887043_19898126_19900554_RR | OBD159_2061 | TCCGCTCCTCTCCTCTTCTCTTA (SEQ ID NO: 2692) |
| 355 | ORF18_21_14553845_14555723_14583254_14600479_FF | OBD159_2065 | GCCTTTCCATTGAAGCCCATTCTTAC (SEQ ID NO: 2694) |
| 356 | ORF18_21_14553845_14555723_14583254_14600479_FF | OBD159_2065 | GCCTTTCCATTGAAGCCCATTCTTAC (SEQ ID NO: 2694) |

TABLE 3.d7-continued

| Probe | PCR-Primer1_ID | PCR_Primer1 |
|---|---|---|
| 357 ORF18_3_46488317_46491053_46529967_46536322_FF | OBD159_2069 | AGGAGGCTGTGTAGACCAAAACCAC G (SEQ ID NO: 2696) |
| 358 ORF18_3_46488317_46491053_46529967_46536322_FF | OBD159_2069 | AGGAGGCTGTGTAGACCAAAACCAC G (SEQ ID NO: 2696) |
| 359 ORF18_3_64194265_64195323_64266976_64268244_FR | OBD159_2073 | GCCTTTCCTTTCTGGCATCATCTGTT (SEQ ID NO: 2698) |
| 360 ORF18_3_64194265_64195323_64266976_64268244_FR | OBD159_2073 | GCCTTTCCTTTCTGGCATCATCTGTT (SEQ ID NO: 2698) |
| 361 ORF18_6_169230654_169232256_169286051_169290790_RR | OBD159_2077 | TATGTTACACCCCTTGGCTACCCAGC (SEQ ID NO: 1058) |
| 362 ORF18_6_169230654_169232256_169286051_169290790_RR | OBD159_2077 | TATGTTACACCCCTTGGCTACCCAGC (SEQ ID NO: 1058) |
| 363 ORF180_3_69108055_69110182_69214794_69217124_RF | OBD159_2081 | CTTGGAGTTTCTTCAAATAAAATC (SEQ ID NO: 2702) |
| 364 ORF180_3_69108055_69110182_69214794_69217124_RF | OBD159_2081 | CTTGGAGTTTCTTCAAATAAAATC (SEQ ID NO: 2702) |
| 365 ORF180_4_88335985_88339586_88412084_88413091_RR | OBD159_2085 | TGGAGAGAAAGACATCAATCACAT (SEQ ID NO: 2704) |
| 366 ORF180_4_88335985_88339586_88412084_88413091_RR | OBD159_2085 | TGGAGAGAAAGACATCAATCACAT (SEQ ID NO: 2704) |
| 367 ORF181_11_84860156_84861867_84918402_84924862_RR | OBD159_2089 | GGTTGAGGAGGCGTATCATTTAGCA C (SEQ ID NO: 2706) |
| 368 ORF181_11_84860156_84861867_84918402_84924862_RR | OBD159_2089 | GGTTGAGGAGGCGTATCATTTAGCA C (SEQ ID NO: 2706) |
| 369 ORF182_1_206383244_206385305_206447306_206449267_FF | OBD159_2093 | CTCTGAAGCCAAGCATAGATAGATG G (SEQ ID NO: 832) |
| 370 ORF182_1_206383244_206385305_206447306_206449267_FF | OBD159_2093 | CTCTGAAGCCAAGCATAGATAGATG G (SEQ ID NO: 832) |
| 371 ORF183_15_74122056_74124006_74177775_74179553_FF | OBD159_2097 | GCTGGGTGCGATGTGTGCCTCTA (SEQ ID NO: 2710) |
| 372 ORF183_15_74122056_74124006_74177775_74179553_FF | OBD159_2097 | GCTGGGTGCGATGTGTGCCTCTA (SEQ ID NO: 2710) |
| 373 ORF183_2_56270885_56277617_56323476_56329636_FF | OBD159_2101 | CCCTAACTTTGACTTGCTATGTGATA (SEQ ID NO: 2712) |
| 374 ORF183_2_56270885_56277617_56323476_56329636_FF | OBD159_2101 | CCCTAACTTTGACTTGCTATGTGATA (SEQ ID NO: 2712) |
| 375 ORF183_21_45837532_45839027_45849840_45851551_FF | OBD159_2105 | CCCTTCCTTCTCCTGTAAGTAGC (SEQ ID NO: 2714) |
| 376 ORF183_21_45837532_45839027_45849840_45851551_FF | OBD159_2105 | CCCTTCCTTCTCCTGTAAGTAGC (SEQ ID NO: 2714) |
| 377 ORF184_Y_14466176_14474218_14520608_14523189_FR | OBD159_2109 | GGGACATTAGTTTACCCAGTATGGAC (SEQ ID NO: 2716) |
| 378 ORF184_Y_14466176_14474218_14520608_14523189_FR | OBD159_2109 | GGGACATTAGTTTACCCAGTATGGAC (SEQ ID NO: 2716) |
| 379 ORF187_2_21325579_21332004_21374795_21382106_FR | OBD159_2113 | GGAGAGAGACTGAAGGCAGGAATG CT (SEQ ID NO: 230) |
| 380 ORF187_2_21325579_21332004_21374795_21382106_FR | OBD159_2113 | GGAGAGAGACTGAAGGCAGGAATG CT (SEQ ID NO: 230) |
| 381 ORF187_6_70128487_70130693_70187099_70190406_RF | OBD159_2117 | GAAGTTTCAAATAGGCAAGCCAACC C (SEQ ID NO: 992) |
| 382 ORF187_6_70128487_70130693_70187099_70190406_RF | OBD159_2117 | GAAGTTTCAAATAGGCAAGCCAACC |

TABLE 3.d7-continued

| Probe | PCR-Primer1_ID | PCR_Primer1 |
|---|---|---|
| | | C (SEQ ID NO: 992) |
| 383 ORF187_7_37211489_37214787_37231292_37233848_RF | OBD159_2121 | GCTTAGGCAGGGCAATGTGCTTCC (SEQ ID NO: 2722) |
| 384 ORF187_7_37211489_37214787_37231292_37233848_RF | OBD159_2121 | GCTTAGGCAGGGCAATGTGCTTCC (SEQ ID NO: 2722) |
| 385 ORF187_8_74044912_74046076_74077219_74079715_RF | OBD159_2125 | AGATGGCTGTGGTGTTCGCTTTGGCA (SEQ ID NO: 2724) |
| 386 ORF187_8_74044912_74046076_74077219_74079715_RF | OBD159_2125 | AGATGGCTGTGGTGTTCGCTTTGGCA (SEQ ID NO: 2724) |
| 387 ORF188_11_104895593_104903291_104915537_104922612_RF | OBD159_2129 | CACAGCCAATCTGACTGGAGAGTAGG (SEQ ID NO: 2726) |
| 388 ORF188_11_104895593_104903291_104915537_104922612_RF | OBD159_2129 | CACAGCCAATCTGACTGGAGAGTAGG (SEQ ID NO: 2726) |
| 389 ORF188_9_117491884_117500665_117513941_117521837_RR | OBD159_2133 | GTCCTGGTCCCTAAGGCTTCACTTGA (SEQ ID NO: 2728) |
| 390 ORF188_9_117491884_117500665_117513941_117521837_RR | OBD159_2133 | GTCCTGGTCCCTAAGGCTTCACTTGA (SEQ ID NO: 2728) |
| 391 ORF19_1_177028175_177032504_177116397_177122010_RR | OBD159_2137 | GGGTCTCCCAATCTCCCTTGATACTT (SEQ ID NO: 2730) |
| 392 ORF19_1_177028175_177032504_177116397_177122010_RR | OBD159_2137 | GGGTCTCCCAATCTCCCTTGATACTT (SEQ ID NO: 2730) |
| 393 ORF19_1_177129764_177133067_177178719_177181987_FR | OBD159_2141 | ATTGGTGGTTTCCCTCTCCTTGTGAT (SEQ ID NO: 2732) |
| 394 ORF19_1_177129764_177133067_177178719_177181987_FR | OBD159_2141 | ATTGGTGGTTTCCCTCTCCTTGTGAT (SEQ ID NO: 2732) |
| 395 ORF19_1_76032659_76035831_76083373_76086337_RR | OBD159_2145 | CGCCAGGGAGGGCATAATCTCTG (SEQ ID NO: 2734) |
| 396 ORF19_1_76032659_76035831_76083373_76086337_RR | OBD159_2145 | CGCCAGGGAGGGCATAATCTCTG (SEQ ID NO: 2734) |
| 397 ORF19_10_76413183_76419817_76444465_76451876_FR | OBD159_2149 | CCACCAGCAGTTATTGAGCATTCCTT (SEQ ID NO: 1195) |
| 398 ORF19_10_76413183_76419817_76444465_76451876_FR | OBD159_2149 | CCACCAGCAGTTATTGAGCATTCCTT (SEQ ID NO: 1195) |
| 399 ORF19_15_59205508_59210997_59259334_59261999_RR | OBD159_2153 | GCCATCCAGGCAGCCAGATACTC (SEQ ID NO: 2738) |
| 400 ORF19_15_59205508_59210997_59259334_59261999_RR | OBD159_2153 | GCCATCCAGGCAGCCAGATACTC (SEQ ID NO: 2738) |
| 401 ORF19_18_35655009_35656946_35676499_35681362_RR | OBD159_2157 | CCCCTTAGGAATGAGATGGGAGG (SEQ ID NO: 2740) |
| 402 ORF19_18_35655009_35656946_35676499_35681362_RR | OBD159_2157 | CCCCTTAGGAATGAGATGGGAGG (SEQ ID NO: 2740) |
| 403 ORF19_2_106158642_106160954_106220910_106222156_FF | OBD159_2161 | AGCAGCCAAGTTTTAGATTTCATA (SEQ ID NO: 2742) |
| 404 ORF19_2_106158642_106160954_106220910_106222156_FF | OBD159_2161 | AGCAGCCAAGTTTTAGATTTCATA (SEQ ID NO: 2742) |
| 405 ORF19_2_20261188_20263397_20361646_20369312_FF | OBD159_2165 | GAAATCTTCCAATAATCTACTGCGGC (SEQ ID NO: 2744) |
| 406 ORF19_2_20261188_20263397_20361646_20369312_FF | OBD159_2165 | GAAATCTTCCAATAATCTACTGCGGC (SEQ ID NO: 2744) |
| 407 ORF19_2_217551078_217557187_217605412_217608263_RR | OBD159_2169 | CTTCTGAGCCTTATGAAAACGGGCAT (SEQ ID NO: 2746) |

TABLE 3.d7-continued

| Probe | PCR-Primer1_ID | PCR_Primer1 |
|---|---|---|
| 408 ORF19_2_217551078_217557187_217605412_217608263_RR | OBD159_2169 | CTTCTGAGCCTTATGAAAACGGGCAT (SEQ ID NO: 2746) |
| 409 ORF19_20_11126224_11127995_11191868_11199236_FR | OBD159_2173 | CCCAACTCTCTCCTTTGACACAACAG (SEQ ID NO: 2748) |
| 410 ORF19_20_11126224_11127995_11191868_11199236_FR | OBD159_2173 | CCCAACTCTCTCCTITGACACAACAG (SEQ ID NO: 2748) |
| 411 ORF19_4_125340607_125343598_125382298_125392915_FR | OBD159_2177 | TCCTCCCACTTCACCTCCTGTGC (SEQ ID NO: 2750) |
| 412 ORF19_4_125340607_125343598_125382298_125392915_FR | OBD159_2177 | TCCTCCCACTTCACCTCCTGTGC (SEQ ID NO: 2750) |
| 413 ORF19_6_5723608_5725733_5745537_5748323_RR | OBD159_2181 | CAACAACCTTTTCCTCACACGCA (SEQ ID NO: 2752) |
| 414 ORF19_6_5723608_5725733_5745537_5748323_RR | OBD159_2181 | CAACAACCTTTTCCTCACACGCA (SEQ ID NO: 2752) |
| 415 ORF191_13_45859224_45860475_45923601_45927773_RR | OBD159_2185 | GCCCTCTTCCTTTCCCTCCTGTA (SEQ ID NO: 2754) |
| 416 ORF191_13_45859224_45860475_45923601_45927773_RR | OBD159_2185 | GCCCTCTTCCTTTCCCTCCTGTA (SEQ ID NO: 2754) |
| 417 ORF191_13_74443077_74451062_74472806_74486278_FR | OBD159_2189 | TCCCTTTGCTAAACTTGCCTCTGCCC (SEQ ID NO: 2756) |
| 418 ORF191_13_74443077_74451062_74472806_74486278_FR | OBD159_2189 | TCCCTTTGCTAAACTTGCCTCTGCCC (SEQ ID NO: 2756) |
| 419 ORF193_1_66143825_66151966_66218811_66223865_FR | OBD159_2193 | ATCCAGAATGAGGCTCTCCCCAGCAT (SEQ ID NO: 2758) |
| 420 ORF193_1_66143825_66151966_66218811_66223865_FR | OBD159_2193 | ATCCAGAATGAGGCTCTCCCCAGCAT (SEQ ID NO: 2758) |
| 421 ORF194_13_74472806_74486278_74508577_74514808_RF | OBD159_2197 | GACAAATCTTCTGTTCCACAAGTTAG (SEQ ID NO: 2760) |
| 422 ORF194_13_74472806_74486278_74508577_74514808_RF | OBD159_2197 | GACAAATCTTCTGTTCCACAAGTTAG (SEQ ID NO: 2760) |
| 423 ORF194_2_19641438_19647635_19660555_19664933_RF | OBD159_2201 | CTACTTGGAGAACAAAAGCCACCAGC (SEQ ID NO: 2762) |
| 424 ORF194_2_19641438_19647635_19660555_19664933_RF | OBD159_2201 | CTACTTGGAGAACAAAAGCCACCAGC (SEQ ID NO: 2762) |
| 425 ORF194_6_27448356_27449458_27517801_27518934_FF | OBD159_2205 | GCTGGCTTTACTGATAACTTCCGAGG (SEQ ID NO: 2764) |
| 426 ORF194_6_27448356_27449458_27517801_27518934_FF | OBD159_2205 | GCTGGCTTTACTGATAACTTCCGAGG (SEQ ID NO: 2764) |
| 427 ORF194_9_105414393_105415801_105438651_105443203_FF | OBD159_2209 | GCGACACCTGCTGGTTGAGAGTG (SEQ ID NO: 2766) |
| 428 ORF194_9_105414393_105415801_105438651_105443203_FF | OBD159_2209 | GCGACACCTGCTGGTTGAGAGTG (SEQ ID NO: 2766) |
| 429 ORF195_2_161568697_161570567_161580634_161587484_RF | OBD159_2213 | TGGTTATTTTGGAGAGGAAAGAAA (SEQ ID NO: 2768) |
| 430 ORF195_2_161568697_161570567_161580634_161587484_RF | OBD159_2213 | TGGTTATTTTGGAGAGGAAAGAAA (SEQ ID NO: 2768) |
| 431 ORF196_6_84687731_84692812_84775145_84786636_RF | OBD159_2217 | GATGACTGTTTTCAGAGACAATGGAA (SEQ ID NO: 324) |
| 432 ORF196_6_84687731_84692812_84775145_84786636_RF | OBD159_2217 | GATGACTGTTTTCAGAGACAATGGAA (SEQ ID NO: 324) |
| 433 ORF197_7_107251976_107254546_107284754_107287455_FR | OBD159_2221 | GCAATGAAGTCTCTAACTGATGAGGC (SEQ ID NO: 2772) |

TABLE 3.d7-continued

| Probe | PCR-Primer1_ID | PCR_Primer1 |
|---|---|---|
| 434 ORF197_7_107251976_107254546_107284754_107287455_FR | OBD159_2221 | GCAATGAAGTCTCTAACTGATGAGG C (SEQ ID NO: 2772) |
| 435 ORF198_8_119154139_119162140_119209458_119214583_RR | OBD159_2225 | TTCAGAAATCAAAGCCCAAAATGC (SEQ ID NO: 2774) |
| 436 ORF198_8_119154139_119162140_119209458_119214583_RR | OBD159_2225 | TTCAGAAATCAAAGCCCAAAATGC (SEQ ID NO: 2774) |

TABLE 3.d8

| | PCR-Primer2_ID | PCR_Primer2 | Marker | GLMNET |
|---|---|---|---|---|
| 331 | OBD159_2023 | CTTCCCTCTTTCACTCTCTCCACCTC (SEQ ID NO: 2776) | OBD159_2021_2023 | 0.002383764 |
| 332 | OBD159_2023 | CTTCCCTCTTTCACTCTCTCCACCTC (SEQ ID NO: 2776) | OBD159_2021_2023 | 0.002383764 |
| 333 | OBD159_2027 | TCTCCAGTTGTTAGTGTTTCAATA (SEQ ID NO: 1536) | OBD159_2025_2027 | 0.000706158 |
| 334 | OBD159_2027 | TCTCCAGTTGTTAGTGTTTCAATA (SEQ ID NO: 1536) | OBD159_2025_2027 | 0.000706158 |
| 335 | OBD159_1975 | CTCACGCCTGGGAGAGTTTGTGC (SEQ ID NO: 2540) | OBD159_1973_1975 | 0.001414727 |
| 336 | OBD159_1975 | CTCACGCCTGGGAGAGTTTGTGC (SEQ ID NO: 2540) | OBD159_1973_1975 | 0.001414727 |
| 337 | OBD159_2031 | ACTACGGAGATTCCAAACTGGCAG (SEQ ID NO: 2782) | OBD159_2029_2031 | 0.002008835 |
| 338 | OBD159_2031 | ACTACGGAGATTCCAAACTGGCAG (SEQ ID NO: 2782) | OBD159_2029_2031 | 0.002008835 |
| 339 | OBD159_2035 | TACCCGACTTGCCAGTATCACTAC (SEQ ID NO: 2784) | OBD159_2033_2035 | 0.001678606 |
| 340 | OBD159_2035 | TACCCGACTTGCCAGTATCACTAC (SEQ ID NO: 2784) | OBD159_2033_2035 | 0.001678606 |
| 341 | OBD159_2039 | CCCTGTTCCTCCCACTTCCTCTTAGA (SEQ ID NO: 2786) | OBD159_2037_2039 | 0.00171494 |
| 342 | OBD159_2039 | CCCTGTTCCTCCCACTTCCTCTTAGA (SEQ ID NO: 2786) | OBD159_2037_2039 | 0.00171494 |
| 343 | OBD159_2043 | GACACCTACCAACCCAGATGCTCTTG (SEQ ID NO: 2788) | OBD159_2041_2043 | 0.000850351 |
| 344 | OBD159_2043 | GACACCTACCAACCCAGATGCTCTTG (SEQ ID NO: 2788) | OBD159_2041_2043 | 0.000850351 |
| 345 | OBD159_2047 | GGAGCCTAAAGTTATGGGAATGTCAT (SEQ ID NO: 2790) | OBD159_2045_2047 | 0.001542025 |
| 346 | OBD159_2047 | GGAGCCTAAAGTTATGGGAATGTCAT (SEQ ID NO: 2790) | OBD159_2045_2047 | 0.001542025 |
| 347 | OBD159_2051 | CACCGTTTCACCTGTGCTATCTTTGA (SEQ ID NO: 2792) | OBD159_2049_2051 | 0.001207274 |
| 348 | OBD159_2051 | CACCGTTTCACCTGTGCTATCTTTGA (SEQ ID NO: 2792) | OBD159_2049_2051 | 0.001207274 |
| 349 | OBD159_2055 | GGCTTTACTTTGTGACTGGCTTGGTA (SEQ ID NO: 2794) | OBD159_2053_2055 | 0.001843195 |
| 350 | OBD159_2055 | GGCTTTACTTTGTGACTGGCTTGGTA (SEQ ID NO: 2794) | OBD159_2053_2055 | 0.001843195 |

TABLE 3.d8-continued

| | PCR-Primer2_ID | PCR_Primer2 | Marker | GLMNET |
|---|---|---|---|---|
| 351 | OBD159_2059 | TGGGCAAGTTTGACTGGACATTTTCT (SEQ ID NO: 2796) | OBD159_2057_2059 | 0.000753371 |
| 352 | OBD159_2059 | TGGGCAAGTTTGACTGGACATTTTCT (SEQ ID NO: 2796) | OBD159_2057_2059 | 0.000753371 |
| 353 | OBD159_2063 | GCTGTTAGCATCAGAAATGAATGGC (SEQ ID NO: 2798) | OBD159_2061_2063 | 0.001707301 |
| 354 | OBD159_2063 | GCTGTTAGCATCAGAAATGAATGGC (SEQ ID NO: 2798) | OBD159_2061_2063 | 0.001707301 |
| 355 | OBD159_2067 | CCAGTGCCTACTCCCAAACGACGATT (SEQ ID NO: 2800) | OBD159_2065_2067 | 0.001673011 |
| 356 | OBD159_2067 | CCAGTGCCTACTCCCAAACGACGATT (SEQ ID NO: 2800) | OBD159_2065_2067 | 0.001673011 |
| 357 | OBD159_2071 | AGTGTGAATACCCAGGAAACTTAGCG (SEQ ID NO: 2802) | OBD159_2069_2071 | 0.002527 |
| 358 | OBD159_2071 | AGTGTGAATACCCAGGAAACTTAGCG (SEQ ID NO: 2802) | OBD159_2069_2071 | 0.002527 |
| 359 | OBD159_2075 | GGAAAGATTGTGGGTAGGTGCTGGGT (SEQ ID NO: 2804) | OBD159_2073_2075 | 0.001051096 |
| 360 | OBD159_2075 | GGAAAGATTGTGGGTAGGTGCTGGGT (SEQ ID NO: 2804) | OBD159_2073_2075 | 0.001051096 |
| 361 | OBD159_2079 | CTTAGTCATAAATCCTTTGGCAGACC (SEQ ID NO: 2806) | OBD159_2077_2079 | 0.00039807 |
| 362 | OBD159_2079 | CTTAGTCATAAATCCTTTGGCAGACC (SEQ ID NO: 2806) | OBD159_2077_2079 | 0.00039807 |
| 363 | OBD159_2083 | CTTGAACTACTTATCCTATTCTTTA (SEQ ID NO: 2808) | OBD159_2081_2083 | 0.000209607 |
| 364 | OBD159_2083 | CTTGAACTACTTATCCTATTCTTTA (SEQ ID NO: 2808) | OBD159_2081_2083 | 0.000209607 |
| 365 | OBD159_2087 | AGTGGGAATAAACTTGTATGGTAT (SEQ ID NO: 2810) | OBD159_2085_2087 | 0.001646676 |
| 366 | OBD159_2087 | AGTGGGAATAAACTTGTATGGTAT (SEQ ID NO: 2810) | OBD159_2085_2087 | 0.001646676 |
| 367 | OBD159_2091 | TCCTGTGATGGGAATCCTTTCTCTGC (SEQ ID NO: 2812) | OBD159_2089_2091 | -0.000136903 |
| 368 | OBD159_2091 | TCCTGTGATGGGAATCCTTTCTCTGC (SEQ ID NO: 2812) | OBD159_2089_2091 | -0.000136903 |
| 369 | OBD159_2095 | GTAAGAACTTCCTGGTGCCCATCCTC (SEQ ID NO: 2814) | OBD159_2093_2095 | 0.000702852 |
| 370 | OBD159_2095 | GTAAGAACTTCCTGGTGCCCATCCTC (SEQ ID NO: 2814) | OBD159_2093_2095 | 0.000702852 |
| 371 | OBD159_2099 | AGTGTTCCTGACAGTGTAGGCGG (SEQ ID NO: 2816) | OBD159_2097_2099 | 0.000137282 |
| 372 | OBD159_2099 | AGTGTTCCTGACAGTGTAGGCGG (SEQ ID NO: 2816) | OBD159_2097_2099 | 0.000137282 |
| 373 | OBD159_2103 | CTGGAGAGGAGGAGTCTTGTTTGCTT (SEQ ID NO: 776) | OBD159_2101_2103 | 0.000847279 |
| 374 | OBD159_2103 | CTGGAGAGGAGGAGTCTTGTTTGCTT (SEQ ID NO: 776) | OBD159_2101_2103 | 0.000847279 |
| 375 | OBD159_2107 | TAGTGAGCCAAGATTGTGCCCTT (SEQ ID NO: 2820) | OBD159_2105_2107 | 0.002510944 |
| 376 | OBD159_2107 | TAGTGAGCCAAGATTGTGCCCTT (SEQ ID NO: 2820) | OBD159_2105_2107 | 0.002510944 |

TABLE 3.d8-continued

| | PCR-Primer2_ID | PCR_Primer2 | Marker | GLMNET |
|---|---|---|---|---|
| 377 | OBD159_2111 | CTGACACAGTCCTAAGCACAGACAT (SEQ ID NO: 2822) | OBD159_2109_2111 | 0.001454009 |
| 378 | OBD159_2111 | CTGACACAGTCCTAAGCACAGACAT (SEQ ID NO: 2822) | OBD159_2109_2111 | 0.001454009 |
| 379 | OBD159_2115 | GGTGAGAGTGACTTGGTGACTTTGAA (SEQ ID NO: 2824) | OBD159_2113_2115 | 0.000271609 |
| 380 | OBD159_2115 | GGTGAGAGTGACTTGGTGACTTTGAA (SEQ ID NO: 2824) | OBD159_2113_2115 | 0.000271609 |
| 381 | OBD159_2119 | GACACCACTTATGTAACTCCTGTTTA (SEQ ID NO: 2826) | OBD159_2117_2119 | 0.00079638 |
| 382 | OBD159_2119 | GACACCACTTATGTAACTCCTGTTTA (SEQ ID NO: 2826) | OBD159_2117_2119 | 0.00079638 |
| 383 | OBD159_2123 | GACCCCAGGGAAAGAGGGAGTAT (SEQ ID NO: 2828) | OBD159_2121_2123 | 0.002143031 |
| 384 | OBD159_2123 | GACCCCAGGGAAAGAGGGAGTAT (SEQ ID NO: 2828) | OBD159_2121_2123 | 0.002143031 |
| 385 | OBD159_2127 | AGGGAGCAAAGATTATCAGACAGTGC (SEQ ID NO: 2830) | OBD159_2125_2127 | 0.000591997 |
| 386 | OBD159_2127 | AGGGAGCAAAGATTATCAGACAGTGC (SEQ ID NO: 2830) | OBD159_2125_2127 | 0.000591997 |
| 387 | OBD159_2131 | CTTCCTACATTCGCTTGACTGGTGAT (SEQ ID NO: 2832) | OBD159_2129_2131 | 0.000713807 |
| 388 | OBD159_2131 | CTTCCTACATTCGCTTGACTGGTGAT (SEQ ID NO: 2832) | OBD159_2129_2131 | 0.000713807 |
| 389 | OBD159_2135 | GGACCACATACTTACATTTGGACCAC (SEQ ID NO: 2834) | OBD159_2133_2135 | 0.002701307 |
| 390 | OBD159_2135 | GGACCACATACTTACATTTGGACCAC (SEQ ID NO: 2834) | OBD159_2133_2135 | 0.002701307 |
| 391 | OBD159_2139 | CAATGAAGGAAAAGAGAGGGAGGAGG (SEQ ID NO: 2836) | OBD159_2137_2139 | 0.001441658 |
| 392 | OBD159_2139 | CAATGAAGGAAAAGAGAGGGAGGAGG (SEQ ID NO: 2836) | OBD159_2137_2139 | 0.001441658 |
| 393 | OBD159_2143 | GAATGGAAGCAACTTGAGGGCAGACC (SEQ ID NO: 2838) | OBD159_2141_2143 | 0.001668614 |
| 394 | OBD159_2143 | GAATGGAAGCAACTTGAGGGCAGACC (SEQ ID NO: 2838) | OBD159_2141_2143 | 0.001668614 |
| 395 | OBD159_2147 | CAAAGCCAGGATGGGACTCAGAG (SEQ ID NO: 2840) | OBD159_2145_2147 | 0.001918512 |
| 396 | OBD159_2147 | CAAAGCCAGGATGGGACTCAGAG (SEQ ID NO: 2840) | OBD159_2145_2147 | 0.001918512 |
| 397 | OBD159_2151 | AGGCTGTGCTTGGCTGGTTGTGTAAC (SEQ ID NO: 1277) | OBD159_2149_2151 | 0.001018689 |
| 398 | OBD159_2151 | AGGCTGTGCTTGGCTGGTTGTGTAAC (SEQ ID NO: 1277) | OBD159_2149_2151 | 0.001018689 |
| 399 | OBD159_2155 | CCCCTAACAGACCAGACCAAACC (SEQ ID NO: 2844) | OBD159_2153_2155 | 0.000307015 |
| 400 | OBD159_2155 | CCCCTAACAGACCAGACCAAACC (SEQ ID NO: 2844) | OBD159_2153_2155 | 0.000307015 |
| 401 | OBD159_2159 | CGCCTGTCAGTGGGAGTGGGAAA (SEQ ID NO: 2846) | OBD159_2157_2159 | 0.001008103 |
| 402 | OBD159_2159 | CGCCTGTCAGTGGGAGTGGGAAA (SEQ ID NO: 2846) | OBD159_2157_2159 | 0.001008103 |

TABLE 3.d8-continued

| | PCR-Primer2_ID | PCR_Primer2 | Marker | GLMNET |
|---|---|---|---|---|
| 403 | OBD159_2163 | CCAAAGTTCTGGGATTACAGGCAT (SEQ ID NO: 2848) | OBD159_2161_2163 | 0.000518272 |
| 404 | OBD159_2163 | CCAAAGTTCTGGGATTACAGGCAT (SEQ ID NO: 2848) | OBD159_2161_2163 | 0.000518272 |
| 405 | OBD159_2167 | CAGTCTCTTTCTCTCTGGAATCC (SEQ ID NO: 2850) | OBD159_2165_2167 | 0.000674888 |
| 406 | OBD159_2167 | CAGTCTCTTTCTCTCTGGAATCC (SEQ ID NO: 2850) | OBD159_2165_2167 | 0.000674888 |
| 407 | OBD159_2171 | GTCCTGAACTCATCCCGTCTTCTCCA (SEQ ID NO: 2852) | OBD159_2169_2171 | 0.000823884 |
| 408 | OBD159_2171 | GTCCTGAACTCATCCCGTCTTCTCCA (SEQ ID NO: 2852) | OBD159_2169_2171 | 0.000823884 |
| 409 | OBD159_2175 | TTGTCCACATCTTCCCCATCTGAGAA (SEQ ID NO: 2854) | OBD159_2173_2175 | 0.001538354 |
| 410 | OBD159_2175 | TTGTCCACATCTTCCCCATCTGAGAA (SEQ ID NO: 2854) | OBD159_2173_2175 | 0.001538354 |
| 411 | OBD159_2179 | TACATTCCTGGTAACACAGCATCCAT (SEQ ID NO: 2856) | OBD159_2177_2179 | 0.000652174 |
| 412 | OBD159_2179 | TACATTCCTGGTAACACAGCATCCAT (SEQ ID NO: 2856) | OBD159_2177_2179 | 0.000652174 |
| 413 | OBD159_2183 | AGCCTGGGTGACAGAGTGAGACC (SEQ ID NO: 2858) | OBD159_2181_2183 | 0.001983308 |
| 414 | OBD159_2183 | AGCCTGGGTGACAGAGTGAGACC (SEQ ID NO: 2858) | OBD159_2181_2183 | 0.001983308 |
| 415 | OBD159_2187 | ATGGAGGTGGTGGGCAATGGCAC (SEQ ID NO: 2860) | OBD159_2185_2187 | 0.002273727 |
| 416 | OBD159_2187 | ATGGAGGTGGTGGGCAATGGCAC (SEQ ID NO: 2860) | OBD159_2185_2187 | 0.002273727 |
| 417 | OBD159_2191 | GGGAGAGGATAGGTTTAGTTGCCT (SEQ ID NO: 2862) | OBD159_2189_2191 | 0 |
| 418 | OBD159_2191 | GGGAGAGGATAGGTTTAGTTGCCT (SEQ ID NO: 2862) | OBD159_2189_2191 | 0 |
| 419 | OBD159_2195 | GAGAAGACAGGAACACTGATGCTATC (SEQ ID NO: 1569) | OBD159_2193_2195 | 0.001003098 |
| 420 | OBD159_2195 | GAGAAGACAGGAACACTGATGCTATC (SEQ ID NO: 1569) | OBD159_2193_2195 | 0.001003098 |
| 421 | OBD159_2199 | GGGAGAGGATAGGTTTAGTTGCCT (SEQ ID NO: 2862) | OBD159_2197_2199 | 0.002044234 |
| 422 | OBD159_2199 | GGGAGAGGATAGGTTTAGTTGCCT (SEQ ID NO: 2862) | OBD159_2197_2199 | 0.002044234 |
| 423 | OBD159_2203 | TGTGCCCTGGAGAAACAGTCTATCTG (SEQ ID NO: 2868) | OBD159_2201_2203 | 0.002653152 |
| 424 | OBD159_2203 | TGTGCCCTGGAGAAACAGTCTATCTG (SEQ ID NO: 2868) | OBD159_2201_2203 | 0.002653152 |
| 425 | OBD159_2207 | CTCCTTCCTCAGCCTTTCTGTTTGAC (SEQ ID NO: 2870) | OBD159_2205_2207 | 0.002407868 |
| 426 | OBD159_2207 | CTCCTTCCTCAGCCTTTCTGTTTGAC (SEQ ID NO: 2870) | OBD159_2205_2207 | 0.002407868 |
| 427 | OBD159_2211 | CCCACATCAGGGCAGAACCATTC (SEQ ID NO: 2872) | OBD159_2209_2211 | 0.001662726 |
| 428 | OBD159_2211 | CCCACATCAGGGCAGAACCATTC (SEQ ID NO: 2872) | OBD159_2209_2211 | 0.001662726 |

TABLE 3.d8-continued

| | PCR-Primer2_ID | PCR_Primer2 | Marker | GLMNET |
|---|---|---|---|---|
| 429 | OBD159_2215 | AGGAAAGCCTCAGTGTTAGAATGC (SEQ ID NO: 2874) | OBD159_2213_2215 | 0.000402127 |
| 430 | OBD159_2215 | AGGAAAGCCTCAGTGTTAGAATGC (SEQ ID NO: 2874) | OBD159_2213_2215 | 0.000402127 |
| 431 | OBD159_2219 | TAAGCAAAGCCCTTCTTCCCCTGTCT (SEQ ID NO: 2876) | OBD159_2217_2219 | 0 |
| 432 | OBD159_2219 | TAAGCAAAGCCCTTCTTCCCCTGTCT (SEQ ID NO: 2876) | OBD159_2217_2219 | 0 |
| 433 | OBD159_2223 | GCTGGTGGAAGGATTGTAAACAGGGA (SEQ ID NO: 2878) | OBD159_2221_2223 | 0.000829972 |
| 434 | OBD159_2223 | GCTGGTGGAAGGATTGTAAACAGGGA (SEQ ID NO: 2878) | OBD159_2221_2223 | 0.000829972 |
| 435 | OBD159_2227 | CTAACTCGCTAACATTTCACTTTT (SEQ ID NO: 2880) | OBD159_2225_2227 | 0.001079616 |
| 436 | OBD159_2227 | CTAACTCGCTAACATTTCACTTTT (SEQ ID NO: 2880) | OBD159_2225_2227 | 0.001079616 |

TABLE 3.d9

| | Gene |
|---|---|
| 331 | AGBL4; ELAVL4; rs11583200 |
| 332 | AGBL4; ELAVL4; rs11583200 |
| 333 | rs17109786; rs148431766 |
| 334 | rs17109786; rs148431766 |
| 335 | PNMAL1; PNMAL2; PPP5D1 |
| 336 | PNMAL1; PNMAL2; PPP5D1 |
| 337 | FKBP1A; RAD21L1; RP11-314N13.10; SDCBP2; SNPH; rs35367003 |
| 338 | FKBP1A; RAD21L1; RP11-314N13.10; SDCBP2; SNPH; rs35367003 |
| 339 | SERTM1; rs11619726 |
| 340 | SERTM1; rs11619726 |
| 341 | rs6914622; rs9497965; rs9497975 |
| 342 | rs6914622; rs9497965; rs9497975 |
| 343 | BCOR; rs2968915 |
| 344 | BCOR; rs2968915 |
| 345 | ADCY2; rs17231202; rs10512928; rs884964; rs12522444; rs11134242 |
| 346 | ADCY2; rs17231202; rs10512928; rs884964; rs12522444; rs11134242 |
| 347 | FGFR2; rs148514974; rs10510097; rs4752569; rs3750817; rs7895676; rs10736303; rs11200014; rs2981579; rs1078806; rs2981578; rs35054928; rs2981575; rs1219648; rs1219642; rs2912774; rs2936870; rs45631563; rs2420946; rs3135724; rs2981582; rs3135718; rs755001161 |
| 348 | FGFR2; rs148514974; rs10510097; rs4752569; rs3750817; rs7895676; rs10736303; rs11200014; rs2981579; rs1078806; rs2981578; rs35054928; rs2981575; rs1219648; rs1219642; rs2912774; rs2936870; rs45631563; rs2420946; rs3135724; rs2981582; rs3135718; rs755001161 |
| 349 | LAMA3; rs1057516512; rs80356678; rs1057516743; rs1057517023; rs1057516475; rs1057517235; rs1057517367; rs7237244 |
| 350 | LAMA3; rs1057516512; rs80356678; rs1057516743; rs1057517023; rs1057516475; rs1057517235; rs1057517367; rs7237244 |
| 351 | CTNNA2; rs6738962 |
| 352 | CTNNA2; rs6738962 |
| 353 | RIN2; rs6046396 |
| 354 | RIN2; rs6046396 |
| 355 | AF165138.7; HSPA13; SAMSN1 |
| 356 | AF165138.7; HSPA13; SAMSN1 |
| 357 | LRRC2; LTF; RTP3 |
| 358 | LRRC2; LTF; RTP3 |
| 359 | PRICKLE2; rs17404667 |
| 360 | PRICKLE2; rs17404667 |
| 361 | THBS2; rs9406328; rs761646500; rs116146467 |
| 362 | THBS2; rs9406328; rs761646500; rs116146467 |
| 363 | ARL6IP5; FRMD4B; LMOD3; rs724159964; rs727502798; rs727502799; rs724159965; rs727502797; rs6787362; rs6806528 |
| 364 | ARL6IP5; FRMD4B; LMOD3; rs724159964; rs727502798; rs727502799; rs724159965; rs727502797; rs6787362; rs6806528 |
| 365 | HERC6; rs12512051 |
| 366 | HERC6; rs12512051 |
| 367 | DLG2 |
| 368 | DLG2 |
| 369 | SRGAP2; rs2987927; rs2480408 |

TABLE 3.d9-continued

| | Gene |
|---|---|
| 370 | SRGAP2; rs2987927; rs2480408 |
| 371 | ISLR; ISLR2; STRA6; rs376998994; rs397514639 |
| 372 | ISLR; ISLR2; STRA6; rs376998994; rs397514639 |
| 373 | CCDC85A; rs6747380 |
| 374 | CCDC85A; rs6747380 |
| 375 | PCBP3; rs56127133 |
| 376 | PCBP3; rs56127133 |
| 377 | NLGN4Y |
| 378 | NLGN4Y |
| 379 | rs2337901; rs11897825 |
| 380 | rs2337901; rs11897825 |
| 381 | COL19A1; rs771562232; rs658805 |
| 382 | COL19A1; rs771562232; rs658805 |
| 383 | ELMO1; rs73112661 |
| 384 | ELMO1; rs73112661 |
| 385 | LY96; rs6472827 |
| 386 | LY96; rs6472827 |
| 387 | CASP4; rs497116 |
| 388 | CASP4; rs497116 |
| 389 | ASTN2; rs2771051 |
| 390 | ASTN2; rs2771051 |
| 391 | ASTN1; rs2861887; rs228014 |
| 392 | ASTN1; rs2861887; rs228014 |
| 393 | ASTN1; BRINP2; rs2861887 |
| 394 | ASTN1; BRINP2; rs2861887 |
| 395 | ST6GALNAC3; rs12095069 |
| 396 | ST6GALNAC3; rs12095069 |
| 397 | C10orf11; rs11593840; rs10509373 |
| 398 | C10orf11; rs11593840; rs10509373 |
| 399 | LDHAL6B; MYO1E; rs7165001; rs387906807; rs2306786 |
| 400 | LDHAL6B; MYO1E; rs7165001; rs387906807; rs2306786 |
| 401 | GALNT1; rs17647532 |
| 402 | GALNT1; rs17647532 |
| 403 | C2orf40; UXS1; rs6738485 |
| 404 | C2orf40; UXS1; rs6738485 |
| 405 | PUM2; rs111612372 |
| 406 | PUM2; rs111612372 |
| 407 | DIRC3; rs6435999 |
| 408 | DIRC3; rs6435999 |
| 409 | rs6040399; rs77790871 |
| 410 | rs6040399; rs77790871 |
| 411 | FAT4; rs1039808 |
| 412 | FAT4; rs1039808 |
| 413 | FARS2; rs775690041 |
| 414 | FARS2; rs775690041 |
| 415 | SIAH3; ZC3H13 |
| 416 | SIAH3; ZC3H13 |
| 417 | rs17714988; rs17718828 |
| 418 | rs17714988; rs17718828 |
| 419 | PDE4B; rs490094; rs10454453; rs486438; rs567279; rs6588190 |
| 420 | PDE4B; rs490094; rs10454453; rs486438; rs567279; rs6588190 |
| 421 | rs17714988; rs17718828 |
| 422 | rs17714988; rs17718828 |
| 423 | rs10856789; rs16986953 |
| 424 | rs10856789; rs16986953 |
| 425 | ZNF184; rs34196306; rs149866169; rs34864796; rs16867808; rs2205829; rs13195040 |
| 426 | ZNF184; rs34196306; rs149866169; rs34864796; rs16867808; rs2205829; rs13195040 |
| 427 | FSD1L; SLC44A1 |
| 428 | FSD1L; SLC44A1 |
| 429 | SLC4A10; rs56037433 |
| 430 | SLC4A10; rs56037433 |
| 431 | TBX18; rs760905589; rs869320679; rs797045022; rs77693245; rs72912698 |
| 432 | TBX18; rs760905589; rs869320679; rs797045022; rs77693245; rs72912698 |
| 433 | COG5; rs773281248; rs3815148 |
| 434 | COG5; rs773281248; rs3815148 |
| 435 | MAL2; rs2468186; rs1425053; rs6989684 |
| 436 | MAL2; rs2468186; rs1425053; rs6989684 |

TABLE 4.a1

| | Probe | GeneLocus |
|---|---|---|
| 1 | ORF1_1_58851578_58854234_58918114_58921170_FR | rs2760501; rs6668586 |
| 2 | ORF1_10_114879815_114883799_114930122_114938828_RR | FAM160B1; TRUB1; rs968847 |
| 3 | ORF1_12_109687914_109689169_109761674_109764027_RR | FAM222A; rs763757845 |

TABLE 4.a1-continued

| Probe | GeneLocus |
|---|---|
| 4 ORF1_14_64426803_64429125_64462354_64463999_RR | MTHFD1; ZBTB25; rs34181110; rs2236225; rs2281603 |
| 5 ORF1_16_23216838_23220910_23281989_23283335_RF | SCNN1B; SCNN1G; rs137853342 |
| 6 ORF1_2_26839991_26843135_26900262_26907333_FR | DPYSL5; rs1371614 |
| 7 ORF1_21_17391129_17392895_17434190_17435748_FF | CXADR |
| 8 ORF1_21_17391129_17392895_17437778_17439433_FF | CXADR |
| 9 ORF1_21_17393292_17394472_17441050_17442330_RR | CXADR |
| 10 ORF1_5_56137297_56140860_56168655_56170386_FR | ANKRD55; rs159572; rs6859219; rs10065637; rs71624119; rs10213692; rs7731626; rs28722705 |
| 11 ORF1_5_56137297_56140860_56180306_56182093_FF | ANKRD55; rs159572; rs6859219; rs10065637; rs71624119; rs10213692; rs7731626; rs28722705 |
| 12 ORF1_5_56137297_56140860_56230314_56232440_FF | ANKRD55; rs1020388; rs6859219; rs10065637; rs71624119; rs10213692; rs7731626; rs28722705; rs159572; rs4700060 |
| 13 ORF1_8_28429398_28430402_28471461_28475878_FR | FBXO16; FZD3 |
| 14 ORF10_1_110141802_110145853_110155952_110164041_RF | SLC6A17; rs775085213 |
| 15 ORF10_1_110155952_110164041_110258457_110260696_FF | KCNC4; SLC6A17; UBL4B; rs775085213; rs375380880 |
| 16 ORF10_10_121564423_121570750_121595209_121596934_FF | FGFR2; rs755001161; rs148514974; rs10510097; rs4752569; rs3750817; rs7895676; rs10736303; rs11200014; rs2981579; rs1078806; rs2981578; rs35054928; rs2981575; rs1219648; rs1219642; rs2912774; rs2936870; rs45631563; rs2420946; rs3135724; rs2981582; rs3135718 |
| 17 ORF10_10_127007_130384_175918_183761_RF | ZMYND11; rs606231267; rs1060499626; rs1135401797 |
| 18 ORF10_11_98953280_98957080_99019353_99022313_FF | CNTN5; rs1394461 |
| 19 ORF10_15_91096267_91099737_91157513_91165785_RF | SV2B; rs886144 |
| 20 ORF10_16_27283060_27288284_27358113_27360574_FR | IL4R; rs769790595; rs2107356; rs3785356; rs1805010; rs764099093; rs370524692; rs3024647 |
| 21 ORF10_3_107626100_107637571_107703592_107708851_RR | BBX; rs670752 |
| 22 ORF10_3_120814252_120821896_120858831_120873172_FR | GTF2E1; rs322458 |
| 23 ORF10_4_37845589_37847420_37862832_37864637_RR | GAFA3; PGM2 |
| 24 ORF10_X_130763205_130766490_130793708_130805512_FR | ARHGAP36; ENOX2 |
| 25 ORF10_X_68908108_68921078_68942609_68947661_FF | EFNB1; rs5937157 |
| 26 ORF100_12_54589309_54591607_54654414_54660876_FR | DCD; LACRT; PPP1R1A |
| 27 ORF101_14_64426803_64429125_64462354_64463999_RR | MTHFD1; ZBTB25; rs34181110; rs2236225; rs2281603 |
| 28 ORF104_6_151443530_151449164_151559030_151566602_FF | C6orf211; CCDC170; RMND1; rs9479072; rs6933660; rs1971256; rs9479055; rs6931664; rs9479068; rs7761420; rs9478217; rs7753676 |
| 29 ORF105_3_85660887_85666710_85682353_85685845_RR | CADM2; rs9829032 |
| 30 ORF106_15_97695238_97699387_97751925_97755483_FR | ARRDC4 |
| 31 ORF106_16_15155840_15159398_15200610_15205140_FR | PDXDC1; rs4003228 |
| 32 ORF107_9_89728565_89736522_89805232_89809003_RR | rs12554199 |
| 33 ORF109_6_82035912_82039349_82086732_82090252_RR | IBTK; rs10806235 |
| 34 ORF109_8_11762928_11765191_11857514_11859558_FR | CTSB; FDFT1; GATA4; NEIL2; rs1466785; rs804279; rs804270; rs148057216; rs8191664; rs7001819; rs2645429; rs2645424; rs6601615; rs8898; rs762727745; rs13332; rs569307763; rs2740594; rs747940576; rs12338 |
| 35 ORF11_10_14255629_14257128_14331424_14334008_FF | FRMD4A; rs12220909; rs1218412 |
| 36 ORF11_15_26044519_26047445_26072122_26074663_FF | rs6576507; rs547843 |
| 37 ORF11_16_11953475_11954578_11996894_11999391_FR | GSPT1; RP11-166B2.1; SNX29; TNFRSF17; rs12922317 |
| 38 ORF11_16_27236516_27245702_27283060_27288284_RF | KDM8; NSMCE1; rs9940555 |
| 39 ORF11_19_48817066_48819208_48918494_48922385_RR | BCAT2; HSD17B14; NUCB1; PLEKHA4; PPP1R15A; TULP2; rs56104184; rs17272694; rs557806; rs595982; rs7260579 |
| 40 ORF11_20_20005082_20006543_20078974_20082009_FR | CFAP61; CRNKL1 A20; RIN2; rs1057519885 |
| 41 ORF11_20_21483562_21487561_21497814_21499630_FF | NKX2-2; NKX2-4 |
| 42 ORF11_4_166285010_166286178_166311616_166318662_FR | rs13113999 |
| 43 ORF11_4_37845589_37847420_37859966_37862832_RR | GAFA3; PGM2 |
| 44 ORF11_X_115875719_115878414_115936015_115945579_RF | PLS3; rs201386833 |
| 45 ORF110_1_48532003_48539768_48618802_48625969_FR | AGBL4; SPATA6; rs2803270 |
| 46 ORF111_1_48532003_48539768_48618802_48625969_FF | AGBL4; SPATA6; rs2803270 |
| 47 ORF112_X_6219982_6227001_6295729_6302842_RF | NLGN4X; rs756651509; rs2290488 |
| 48 ORF113_17_35163743_35164806_35182581_35189768_RF | SLC35G3; UNC45B; rs370424081 |
| 49 ORF114_21_29891288_29892971_29934336_29938623_RR | GRIK1; rs455804 |
| 50 ORF115_7_36953187_36955186_36976432_36980351_RR | ELMO1; rs6942726 |
| 51 ORF117_5_56056790_56059051_56069488_56074299_RR | ANKRD55; rs715180 |
| 52 ORF117_7_22390272_22396878_22494715_22499120_FR | RAPGEF5; STEAP1B |
| 53 ORF117_8_122799764_122802282_122834548_122836477_RR | ZHX2; rs10108684 |
| 54 ORF117_8_13602479_13607345_13632064_13635521_RR | C8orf48 |
| 55 ORF118_9_114547520_114550346_114637124_114640336_RF | ATP6V1G1; C9orf91; rs10513249; rs10817638 |
| 56 ORF118_X_129688045_129690722_129712806_129719890_FR | rs3788853; rs56204867 |
| 57 ORF119_18_58181079_58183629_58202022_58205094_RF | NEDD4L; rs4149601 |
| 58 ORF12_10_3728370_3731203_3766614_3768148_RR | KLF6; rs705464 |

TABLE 4.a1-continued

| Probe | GeneLocus |
|---|---|
| 59 ORF12_10_86379474_86383560_86442251_86449187_RF | WAPAL; rs7075426; rs731171; rs182554582 |
| 60 ORF12_12_10186674_10187896_10218366_10224430_RF | GABARAPL1; KLRD1; TMEM52B |
| 61 ORF12_12_82971707_82974166_83009437_83013253_RF | TMTC2; rs7961953 |
| 62 ORF12_12_83941063_83942894_83954032_83957600_FR | rs11116045; rs1545843 |
| 63 ORF12_15_91096267_91099737_91157513_91165785_RR | SV2B; rs886144 |
| 64 ORF12_16_10002949_10008026_10047306_10049395_RF | GRIN2A; rs4107019; rs11644461; rs7192557 |
| 65 ORF12_2_79968604_79971437_79981700_79985274_FR | CTNNA2; rs6752828 |
| 66 ORF12_20_10249014_10252827_10332102_10337846_FF | SNAP25; rs363043; rs363050; rs362584; rs797044873; rs3787283; rs3746544; rs1051312 |
| 67 ORF12_3_159122585_159126737_159171258_159178334_RR | IQCJ; IQCJ-SCHIP1; rs13064773 |
| 68 ORF12_4_125301039_125303568_125344175_125348116_FR | FAT4; rs587777724; rs587777725; rs1039808 |
| 69 ORF12_6_41251004_41262260_41306014_41314411_FF | TREM1; TREML4; rs74851542; rs2234246; rs6910730; rs2234237; rs3789205; rs9471535 |
| 70 ORF12_6_5723608_5725733_5763384_5777490_RF | FARS2; rs397514612; rs775690041 |
| 71 ORF12_7_69585104_69587963_69646882_69650626_RF | AUTS2; rs4718886 |
| 72 ORF12_8_93942397_93946048_93985677_93987921_FF | PDP1; rs7006531 |
| 73 ORF12_X_118654955_118657669_118719838_118725132_RR | DOCK11; IL13RA1 |
| 74 ORF121_10_62722126_62724612_62762850_62765655_RR | rs35306388; rs442309; rs58600253 |
| 75 ORF121_4_114660322_114662941_114712388_114716541_RF | UGT8; rs78557978 |
| 76 ORF123_6_151443530_151449164_151468540_151471174_FR | C6orf211; RMND1; rs370863743 |
| 77 ORF124_5_42377041_42385919_42424469_42426692_FF | GHR; rs6898743 |
| 78 ORF124_9_125044256_125047827_125094721_125098576_FF | PPP6C; SCAI |
| 79 ORF124_X_44196000_44203617_44233955_44239522_FF | EFHC2; rs7055196 |
| 80 ORF125_5_141308791_141312972_141341365_141343244_RF | PCDHGA1; PCDHGA2; PCDHGA3; TAF7; rs563151485; rs61749035 |
| 81 ORF125_6_28490451_28494501_28536924_28541272_FR | GPX5; GPX6; rs2394103; rs35701070; rs974334; rs13191038; rs406113; rs6456823; rs11757235 |
| 82 ORF126_2_68188547_68193452_68260319_68261595_RF | HZGJ; PPP3R1; rs2120335; rs12052801; rs1822469; rs12465425 |
| 83 ORF126_5_162107624_162113021_162154110_162157909_RR | GABRG2; rs211037; rs397514737; rs121909672; rs1060501889; rs121909674 |
| 84 ORF128_3_63280859_63282281_63322701_63329776_FF | SYNPR; rs13098482 |
| 85 ORF13_1_203216286_203223882_203265130_203266595_RR | CHIT1; rs871799; rs3831317; rs2297950; rs137852607 |
| 86 ORF13_1_208028237_208035325_208092230_208093532_FR | PLXNA2; rs11578508; rs841865; rs752016; rs1327175; rs2478813; rs2498028; rs716461 |
| 87 ORF13_12_123039105_123047896_123111911_123114094_FF | PITPNM2; rs1727294; rs1727307; rs7132277 |
| 88 ORF13_12_22550236_22564251_22589587_22591499_RF | C2CD5; ETNK1 |
| 89 ORF13_13_52983399_52988983_53034265_53036683_FF | OLFM4; rs9568797 |
| 90 ORF13_2_11504797_11509096_11532162_11535545_RR | E2F6; GREB1; rs77294520 |
| 91 ORF13_20_38210518_38212890_38329699_38336059_RR | BPI; KIAA1755; rs6024947; rs6123471; rs6127471; rs4811602; rs877600; rs1341023; rs5743507; rs4358188 |
| 92 ORF13_4_187957960_187960546_188016179_188019108_FF | ZFP42; rs6825162; rs6837349; rs4862848 |
| 93 ORF13_6_154259046_154260916_154294994_154298490_RF | CNKSR3; IPCEF1; OPRM1 |
| 94 ORF13_7_22365643_22368712_22390272_22396878_RF | RAPGEF5; STEAP1B |
| 95 ORF13_8_52230322_52233827_52248401_52253166_RF | ST18; rs2360806 |
| 96 ORF130_2_77483560_77486991_77514867_77519288_FR | LRRTM4; rs61354037 |
| 97 ORF131_19_9846242_9849549_9869701_9871067_RF | OLFM2; PIN1; rs2233682; rs2287838; rs779032127 |
| 98 ORF132_5_17887397_17895130_17964289_17970189_RR | rs140236920 |
| 99 ORF133_10_30527367_30529631_30585089_30589121_RR | LYZL2; MAP3K8 |
| 100 ORF134_14_68255587_68260022_68325745_68327713_RR | RAD51B; rs1570106; rs17105278; rs4902562; rs3784099; rs2208397; rs911263; rs2104047; rs1950897; rs11158728; rs927220; rs61985136; rs8017304; rs1956529; rs4902566 |
| 101 ORF138_17_35287155_35289074_35314277_35315961_FF | SLFN11; SLFN5 |
| 102 ORF138_6_151387953_151393542_151443530_151449164_RF | C6orf211; RMND1; ZBTB2; rs115079861; rs886037773; rs886037771; rs397515421; rs1057519299; rs773470671; rs144972972; rs771894262; rs606231472; rs886037772; rs370863743 |
| 103 ORF138_6_169185535_169187937_169230654_169232256_FR | THBS2; rs9406328 |
| 104 ORF139_14_51886119_51892276_51935246_51939339_FF | GNG2; rs8015138 |
| 105 ORF14_1_110155952_110164041_110184326_110187411_FF | SLC6A17; rs375380880; rs775085213 |
| 106 ORF14_1_76048774_76050727_76086337_76098934_RF | ST6GALNAC3; rs915404 |
| 107 ORF14_18_23965423_23972468_24001102_24007770_RF | LAMA3; TTC39C |
| 108 ORF14_3_159142637_159144036_159166834_159171258_RF | IQCJ; IQCJ-SCHIP1; rs13064773 |
| 109 ORF14_3_159142637_159144036_159171258_159178334_RR | IQCJ; IQCJ-SCHIP1; rs13064773 |
| 110 ORF14_4_152216416_152218364_152243834_152246201_FR | FBXW7; rs522743 |
| 111 ORF14_4_187957960_187960546_188016179_188019108_FF | ZFP42; rs6825162; rs6837349; rs4862848 |
| 112 ORF14_8_65603423_65608237_65633322_65635344_FR | ARMC1; MTFR1 |
| 113 ORF14_9_114559604_114561408_114637124_114640336_RF | ATP6V1G1; C9orf91; rs10513249; rs10817638 |
| 114 ORF141_9_33273553_33275175_33317596_33319558_RF | BAG1; CHMP5; NFX1 |
| 115 ORF141_X_40497397_40499087_40520869_40522158_FR | BCOR; rs2968915 |
| 116 ORF142_X_40497397_40499087_40520869_40522158_FF | BCOR; rs2968915 |
| 117 ORF143_7_36953187_36955186_36980351_36983506_RR | ELMO1; rs6942726 |
| 118 ORF144_14_91001527_91004763_91060989_91062696_RR | C14orf159; RPS6KA5; rs1286150; rs11848357 |
| 119 ORF144_2_167702360_167710563_167770932_167773324_RF | rs971257; rs116677506 |

TABLE 4.a1-continued

| Probe | GeneLocus |
|---|---|
| 120 ORF144_2_44766242_44769058_44787731_44792832_RF | CAMKMT; SIX3 |

TABLE 4.a2

| | Probe_Count_Total | Probe_Count_Sig | HyperG_Stats |
|---|---|---|---|
| 1 | NA | NA | NA |
| 2 | 18; 18 | 1; 1 | 0.357137933; 0.357137933 |
| 3 | 55 | 1 | 0.250357845 |
| 4 | 94; 90 | 3; 1; 3; 1 | 0.213331923; 0.072103962; 0.219233776; 0.082047788 |
| 5 | 16; 26 | 1; 2; 1 | 0.343724359; 0.19032457; 0.373699919 |
| 6 | 47 | 1 | 0.29419612 |
| 7 | 45 | 6; 1 | 0.006017292; 0.285503815 |
| 8 | 45 | 6; 1 | 0.006017292; 0.285503815 |
| 9 | 45 | 6; 1 | 0.006017292; 0.285503815 |
| 10 | 72 | 5 | 0.087766242 |
| 11 | 72 | 5 | 0.087766242 |
| 12 | 72 | 5 | 0.087766242 |
| 13 | 63; 57 | 3; 3; 3; 3 | 0.216848517; 0.224771745; 0.202795213; 0.214348844 |
| 14 | 68 | 8 | 0.005458299 |
| 15 | 49; 68; 56 | 4; 8; 4 | 0.096088025; 0.005458299; 0.123346872 |
| 16 | 190 | 5; 4 | 0.112399625; 0.054978865 |
| 17 | 51 | 1 | 0.249886334 |
| 18 | 18 | 1 | 0.357137933 |
| 19 | 14 | 2 | 0.096260668 |
| 20 | 57 | 1 | 0.239596043 |
| 21 | 30 | 4; 5 | 0.022454364; 0.006393518 |
| 22 | 21 | 1 | 0.369816322 |
| 23 | 37; 37 | 5; 8; 5; 8 | 0.010942367; 0.000107113; 0.010942367; 0.000107113 |
| 24 | 9; 34 | 1; 2; 1; 2 | 0.255358235; 0.047199169; 0.357029649; 0.251319324 |
| 25 | 24 | 1 | 0.375945017 |
| 26 | 8; 17; 21 | 1; 2; 2 | 0.249326315; 0.126473611; 0.164464127 |
| 27 | 94; 90 | 3; 1; 3; 1 | 0.213331923; 0.072103962; 0.219233776; 0.082047788 |
| 28 | 63; 46; 75 | 3; 5; 2; 4; 3; 5 | 0.216848517; 0.076682692; 0.273777277; 0.084172061; 0.228845362; 0.1125292 |
| 29 | 8 | 1 | 0.249326315 |
| 30 | 2 | 1 | 0.074939792 |
| 31 | 38 | 2; 1 | 0.255573168; 0.325888812 |
| 32 | NA | NA | NA |
| 33 | 15 | 2; 1 | 0.095167761; 0.346011739 |
| 34 | 52; 53; 21; 42 | 1; 1; 1; 1 | 0.244043749; 0.238249082; 0.37425716; 0.303213711 |
| 35 | 107 | 3; 2 | 0.188257442; 0.10954189 |
| 36 | NA | NA | NA |
| 37 | 18; 46; 103; 18 | 1; 1; 1; 3; 1 | 0.357137933; 0.299630226; 0.069157027; 0.178958558; 0.357137933 |
| 38 | 40; 62 | 1; 1 | 0.330827809; 0.213548789 |
| 39 | 7; 19; 59; 59; 62; 58 | 1; 1; 1; 1; 1; 1 | 0.215038813; 0.362286681; 0.229012733; 0.229012733; 0.213548789; 0.234279681 |
| 40 | 15; 17; 104; 175 | 1; 1; 1; 1; 1; 1; 4; 4 | 0.335307856; 0.346011739; 0.350975055; 0.359834557; 0.067095696; 0.05179789; 0.096861772; 0.075450093 |
| 41 | 90; 51 | 1; 1 | 0.101520575; 0.272236181 |
| 42 | NA | NA | NA |
| 43 | 37; 37 | 5; 8; 5; 8 | 0.010942367; 0.000107113; 0.010942367; 0.000107113 |
| 44 | 29 | 2; 5 | 0.211050406; 0.005560973 |
| 45 | 93; 9 | 1; 5; 4 | 0.093070545; 0.156450038; 0.000317369 |
| 46 | 93; 9 | 1; 5; 4 | 0.093070545; 0.156450038; 0.000317369 |
| 47 | 31 | 1 | 0.359323344 |
| 48 | 38; 51 | 1; 1 | 0.340322106; 0.272236181 |
| 49 | 9 | 1 | 0.255358235 |
| 50 | 135 | 4; 2 | 0.167299602; 0.052146884 |
| 51 | 72 | 5 | 0.087766242 |
| 52 | 107; 149 | 3; 3 | 0.188257442; 0.096032365 |
| 53 | 69 | 1 | 0.155641612 |
| 54 | 8 | 2; 1 | 0.033505489; 0.249326315 |
| 55 | 113; 113 | 1; 1; 1; 1 | 0.050893345; 0.038148244; 0.050893345; 0.038148244 |
| 56 | NA | NA | NA |
| 57 | 33 | 4; 2 | 0.029769861; 0.246924146 |
| 58 | 53 | 1 | 0.238249082 |
| 59 | 78 | 1 | 0.141989949 |
| 60 | 29; 26; 59 | 2; 2; 2; 1; 2; 2 | 0.211050406; 0.22548219; 0.19032457; 0.373699919; 0.269881341; 0.261532562 |
| 61 | 27 | 2; 1 | 0.197546356; 0.37173223 |
| 62 | NA | NA | NA |
| 63 | 14 | 2 | 0.096260668 |
| 64 | 105 | 2; 1 | 0.137861813; 0.050084955 |

TABLE 4.a2-continued

| | Probe_Count_Total | Probe_Count_Sig | HyperG_Stats |
|---|---|---|---|
| 65 | 40 | 2; 3 | 0.261899069; 0.150241062 |
| 66 | 63 | 1 | 0.184056651 |
| 67 | 22; 33 | 3; 3 | 0.042821316; 0.098061922 |
| 68 | 19 | 3; 4 | 0.030348034; 0.006361707 |
| 69 | 39; 29 | 1; 1 | 0.320372604; 0.366349054 |
| 70 | 37 | 1; 2 | 0.34481748; 0.262259643 |
| 71 | 83 | 1 | 0.123780263 |
| 72 | 38 | 2; 1 | 0.255573168; 0.325888812 |
| 73 | 13; 13 | 1; 2 | 0.314642613; 0.076537269 |
| 74 | NA | NA | NA |
| 75 | 7 | 1 | 0.227740664 |
| 76 | 63; 75 | 3; 5; 3; 5 | 0.216848517; 0.076682692; 0.228845362; 0.1125292 |
| 77 | 16 | 1; 2 | 0.343724359; 0.116490918 |
| 78 | 21; 18 | 1; 1 | 0.37425716; 0.364965787 |
| 79 | 23 | 1 | 0.374075448 |
| 80 | 41; 33; 31; 26 | 1; 1; 1; 1 | 0.309016356; 0.35096223; 0.359323344; 0.373699919 |
| 81 | 34; 20 | 1; 1 | 0.346365974; 0.372098641 |
| 82 | 9; 4 | 1; 1 | 0.268692312; 0.14804367 |
| 83 | 6 | 1 | 0.203777963 |
| 84 | 41 | 2; 1 | 0.26460109; 0.309016356 |
| 85 | 10 | 1 | 0.285987033 |
| 86 | 69 | 1 | 0.155641612 |
| 87 | 62 | 1 | 0.213548789 |
| 88 | 11; 9 | 1; 1 | 0.301350316; 0.268692312 |
| 89 | 26 | 2 | 0.205329626 |
| 90 | 48; 40 | 4; 1; 4; 1 | 0.078104352; 0.267628012; 0.050377953; 0.314741981 |
| 91 | 77; 57 | 1; 1 | 0.123007769; 0.215667339 |
| 92 | 29 | 1; 1 | 0.371537436; 0.366349054 |
| 93 | 163; 163; 140 | 4; 2; 4; 2; 4; 2 | 0.117375195; 0.022678142; 0.117375195; 0.022678142; 0.158806697; 0.045194146 |
| 94 | 107; 149 | 3; 3 | 0.188257442; 0.096032365 |
| 95 | 78 | 2; 4 | 0.222357541; 0.186212358 |
| 96 | 9 | 3; 2 | 0.00391071; 0.047199169 |
| 97 | 149; 153 | 1; 1 | 0.015913046; 0.013923327 |
| 98 | NA | NA | NA |
| 99 | 68; 53 | 1; 1 | 0.184410962; 0.261255041 |
| 100 | 17 | 3; 2 | 0.023054538; 0.126473611 |
| 101 | 22; 26 | 1; 1 | 0.375573766; 0.373699919 |
| 102 | 63; 75; 76 | 3; 5; 3; 5; 1 | 0.216848517; 0.076682692; 0.228845362; 0.1125292; 0.149832643 |
| 103 | 46 | 2; 3 | 0.273777277; 0.178397403 |
| 104 | 36 | 2; 3 | 0.247980559; 0.12891994 |
| 105 | 68 | 8 | 0.005458299 |
| 106 | 45 | 5; 5 | 0.022343156; 0.028833151 |
| 107 | 82; 83 | 1; 2; 1 | 0.127264367; 0.188524907; 0.102353336 |
| 108 | 22; 33 | 3; 3 | 0.042821316; 0.098061922 |
| 109 | 22; 33 | 3; 3 | 0.042821316; 0.098061922 |
| 110 | 143 | 3;2 | 0.107765005; 0.041422991 |
| 111 | 29 | 1; 1 | 0.371537436; 0.366349054 |
| 112 | 48; 28 | 5; 4; 2; 1 | 0.02780594; 0.092112824; 0.204457601; 0.369266824 |
| 113 | 113; 113 | 1; 1; 1; 1 | 0.050893345; 0.038148244; 0.050893345; 0.038148244 |
| 114 | 12; 22; 28 | 4; 1; 5; 1; 5; 1 | 0.000827358; 0.314913912; 0.001196845; 0.375573766; 0.003522831; 0.369266824 |
| 115 | 3 | 3; 1 | 5.91e−05; 0.042102538 |
| 116 | 3 | 3; 1 | 5.91e−05; 0.042102538 |
| 117 | 135 | 4;2 | 0.167299602; 0.052146884 |
| 118 | 24; 88 | 1; 2 | 0.375945017; 0.167789783 |
| 119 | NA | NA | NA |
| 120 | 16; 16 | 1; 1 | 0.343724359; 0.343724359 |

TABLE 4.a3

| | FDR_HyperG | Percent_Sig | logFC | AveExpr |
|---|---|---|---|---|
| 1 | NA | NA | 0.512391512 | 0.512391512 |
| 2 | 0.375519541; 0.375519541 | 5.56; 5.56 | 0.554083838 | 0.554083838 |
| 3 | 0.375519541 | 1.82 | 0.495818977 | 0.495818977 |
| 4 | 0.375519541; 0.376115439; 0.375519541; 0.376115439 | 3.19; 1.06; 3.33; 1.11 | 0.549448158 | 0.549448158 |
| 5 | 0.375519541; 0.375519541; 0.376115439 | 6.25; 7.69; 3.85 | 0.548142412 | 0.548142412 |
| 6 | 0.375519541 | 2.13 | 0.500436606 | 0.500436606 |
| 7 | 0.242080288; 0.376115439 | 13.33; 2.22 | 0.498976751 | 0.498976751 |
| 8 | 0.242080288; 0.376115439 | 13.33; 2.22 | 0.530470107 | 0.530470107 |
| 9 | 0.242080288; 0.376115439 | 13.33; 2.22 | 0.505696778 | 0.505696778 |
| 10 | 0.375519541 | 6.94 | 0.519474296 | 0.519474296 |

TABLE 4.a3-continued

| | FDR_HyperG | Percent_Sig | logFC | AveExpr |
|---|---|---|---|---|
| 11 | 0.375519541 | 6.94 | 0.513921274 | 0.513921274 |
| 12 | 0.375519541 | 6.94 | 0.492941201 | 0.492941201 |
| 13 | 0.375519541; 0.376115439; 0.375519541; 0.376115439 | 4.76; 4.76; 5.26; 5.26 | 0.498701064 | 0.498701064 |
| 14 | 0.217379602 | 11.76 | 0.591810053 | 0.591810053 |
| 15 | 0.376115439; 0.217379602; 0.376115439 | 8.16; 11.76; 7.14 | 0.506870902 | 0.506870902 |
| 16 | 0.375519541; 0.376115439 | 2.63; 2.11 | 0.53203974 | 0.53203974 |
| 17 | 0.376115439 | 1.96 | 0.535671314 | 0.535671314 |
| 18 | 0.375519541 | 5.56 | 0.560634913 | 0.560634913 |
| 19 | 0.376115439 | 14.29 | 0.538523405 | 0.538523405 |
| 20 | 0.375519541 | 1.75 | 0.581440892 | 0.581440892 |
| 21 | 0.375519541; 0.217379602 | 13.33; 16.67 | 0.542968688 | 0.542968688 |
| 22 | 0.375519541 | 4.76 | 0.495604879 | 0.495604879 |
| 23 | 0.357678624; 0.013656923; 0.357678624; 0.013656923 | 13.51; 21.62; 13.51; 21.62 | 0.56026758 | 0.56026758 |
| 24 | 0.375519541; 0.376115439; 0.375519541; 0.376115439 | 11.11; 22.22; 2.94; 5.88 | 0.50907406 | 0.50907406 |
| 25 | 0.376115439 | 4.17 | 0.514728586 | 0.514728586 |
| 26 | 0.376115439; 0.376115439; 0.376115439 | 12.5; 11.76; 9.52 | 0.558078621 | 0.558078621 |
| 27 | 0.375519541; 0.376115439; 0.375519541; 0.376115439 | 3.19; 1.06; 3.33; 1.11 | 0.555500586 | 0.555500586 |
| 28 | 0.375519541; 0.376115439; 0.375519541; 0.376115439; 0.375519541; 0.376115439 | 4.76; 7.94; 4.35; 8.7; 4; 6.67 | 0.506064368 | 0.506064368 |
| 29 | 0.376115439 | 12.5 | 0.528154277 | 0.528154277 |
| 30 | 0.375519541 | 50 | 0.521562164 | 0.521562164 |
| 31 | 0.375519541; 0.376115439 | 5.26; 2.63 | 0.494634685 | 0.494634685 |
| 32 | NA | NA | 0.546740356 | 0.546740356 |
| 33 | 0.375519541; 0.376115439 | 13.33; 6.67 | 0.547454292 | 0.547454292 |
| 34 | 0.376115439; 0.376115439; 0.376115439; 0.376115439 | 1.92; 1.89; 4.76; 2.38 | 0.569015638 | 0.569015638 |
| 35 | 0.375519541; 0.376115439 | 2.8; 1.87 | 0.522699551 | 0.522699551 |
| 36 | NA | NA | 0.496476276 | 0.496476276 |
| 37 | 0.375519541; 0.375519541; 0.375519541; 0.376115439; 0.375519541 | 5.56; 2.17; 0.97; 2.91; 5.56 | 0.552736089 | 0.552736089 |
| 38 | 0.375519541; 0.375519541 | 2.5; 1.61 | 0.499371507 | 0.499371507 |
| 39 | 0.375519541; 0.375519541; 0.375519541; 0.375519541; 0.375519541; 0.375519541 | 14.29; 5.26; 1.69; 1.69; 1.61; 1.72 | 0.533451866 | 0.533451866 |
| 40 | 0.375519541; 0.376115439; 0.375519541; 0.376115439; 0.375519541; 0.376115439; 0.375519541; 0.376115439 | 6.67; 6.67; 5.88; 5.88; 0.96; 0.96; 2.29; 2.29 | 0.50671489 | 0.50671489 |
| 41 | 0.375519541; 0.375519541 | 1.11; 1.96 | 0.500870049 | 0.500870049 |
| 42 | NA | NA | 0.542666527 | 0.542666527 |
| 43 | 0.357678624; 0.013656923; 0.357678624; 0.013656923 | 13.51; 21.62; 13.51; 21.62 | 0.568391567 | 0.568391567 |
| 44 | 0.375519541; 0.217379602 | 6.9; 17.24 | 0.558239253 | 0.558239253 |
| 45 | 0.375519541; 0.376115439; 0.029015407 | 1.08; 5.38; 44.44 | 0.643128478 | 0.643128478 |
| 46 | 0.375519541; 0.376115439; 0.029015407 | 1.08; 5.38; 44.44 | 0.648504396 | 0.648504396 |
| 47 | 0.376115439 | 3.23 | 0.687940877 | 0.687940877 |
| 48 | 0.375519541; 0.375519541 | 2.63; 1.96 | 0.522128489 | 0.522128489 |
| 49 | 0.375519541 | 11.11 | 0.521897056 | 0.521897056 |
| 50 | 0.375519541; 0.376115439 | 2.96; 1.48 | 0.632249447 | 0.632249447 |
| 51 | 0.375519541 | 6.94 | 0.496055077 | 0.496055077 |
| 52 | 0.375519541; 0.375519541 | 2.8; 2.01 | 0.847682313 | 0.847682313 |
| 53 | 0.376115439 | 1.45 | 0.526831442 | 0.526831442 |
| 54 | 0.375519541; 0.376115439 | 25; 12.5 | 0.602529816 | 0.602529816 |
| 55 | 0.375519541; 0.376115439; 0.375519541; 0.376115439 | 0.88; 0.88; 0.88; 0.88 | 0.523498591 | 0.523498591 |
| 56 | NA | NA | 0.493252598 | 0.493252598 |
| 57 | 0.375519541; 0.376115439 | 12.12; 6.06 | 0.495719643 | 0.495719643 |
| 58 | 0.376115439 | 1.89 | 0.538330172 | 0.538330172 |
| 59 | 0.375519541 | 1.28 | 0.601783589 | 0.601783589 |
| 60 | 0.375519541; 0.376115439; 0.375519541; 0.376115439; 0.375519541; 0.376115439 | 6.9; 6.9; 7.69; 3.85; 3.39; 3.39 | 0.525962054 | 0.525962054 |
| 61 | 0.375519541; 0.376115439 | 7.41; 3.7 | 0.525549931 | 0.525549931 |
| 62 | NA | NA | 0.557788433 | 0.557788433 |
| 63 | 0.376115439 | 14.29 | 0.525324032 | 0.525324032 |
| 64 | 0.375519541; 0.376115439 | 1.9; 0.95 | 0.621088697 | 0.621088697 |
| 65 | 0.375519541; 0.376115439 | 5; 7.5 | 0.677723011 | 0.677723011 |
| 66 | 0.376115439 | 1.59 | 0.53163061 | 0.53163061 |
| 67 | 0.375519541; 0.375519541 | 13.64; 9.09 | 0.536635995 | 0.536635995 |
| 68 | 0.375519541; 0.217379602 | 15.79; 21.05 | 0.578945234 | 0.578945234 |
| 69 | 0.376115439; 0.376115439 | 2.56; 3.45 | 0.505795513 | 0.505795513 |
| 70 | 0.375519541; 0.376115439 | 2.7; 5.41 | 0.529076251 | 0.529076251 |
| 71 | 0.375519541 | 1.2 | 0.493021263 | 0.493021263 |
| 72 | 0.375519541; 0.376115439 | 5.26; 2.63 | 0.519212964 | 0.519212964 |
| 73 | 0.375519541; 0.375519541 | 7.69; 15.38 | 0.610109081 | 0.610109081 |
| 74 | NA | NA | 0.569951514 | 0.569951514 |
| 75 | 0.376115439 | 14.29 | 0.507308688 | 0.507308688 |

TABLE 4.a3-continued

| | FDR_HyperG | Percent_Sig | logFC | AveExpr |
|---|---|---|---|---|
| 76 | 0.375519541; 0.376115439; 0.375519541; 0.376115439 | 4.76; 7.94; 4; 6.67 | 0.529494353 | 0.529494353 |
| 77 | 0.375519541; 0.376115439 | 6.25; 12.5 | 0.615759002 | 0.615759002 |
| 78 | 0.376115439; 0.376115439 | 4.76; 5.56 | 0.543830358 | 0.543830358 |
| 79 | 0.375519541 | 4.35 | 0.552021975 | 0.552021975 |
| 80 | 0.376115439; 0.376115439; 0.376115439 | 2.44; 3.03; 3.23; 3.85 | 0.511462115 | 0.511462115 |
| 81 | 0.376115439; 0.376115439 | 2.94; 5 | 0.606358104 | 0.606358104 |
| 82 | 0.376115439; 0.376115439 | 11.11; 25 | 0.536517858 | 0.536517858 |
| 83 | 0.376115439 | 16.67 | 0.560038868 | 0.560038868 |
| 84 | 0.375519541; 0.376115439 | 4.88; 2.44 | 0.515514819 | 0.515514819 |
| 85 | 0.376115439 | 10 | 0.52699264 | 0.52699264 |
| 86 | 0.376115439 | 1.45 | 0.561634704 | 0.561634704 |
| 87 | 0.375519541 | 1.61 | 0.516227401 | 0.516227401 |
| 88 | 0.376115439; 0.376115439 | 9.09; 11.11 | 0.708307997 | 0.708307997 |
| 89 | 0.376115439 | 7.69 | 0.515116689 | 0.515116689 |
| 90 | 0.375519541; 0.376115439; 0.375519541; 0.376115439 | 8.33; 2.08; 10; 2.5 | 0.527088069 | 0.527088069 |
| 91 | 0.376115439; 0.376115439 | 1.3; 1.75 | 0.50771261 | 0.50771261 |
| 92 | 0.375519541; 0.376115439 | 3.45; 3.45 | 0.515351129 | 0.515351129 |
| 93 | 0.375519541; 0.376115439; 0.375519541; 0.376115439; 0.375519541; 0.376115439 | 2.45; 1.23; 2.45; 1.23; 2.86; 1.43 | 0.606390225 | 0.606390225 |
| 94 | 0.375519541; 0.375519541 | 2.8; 2.01 | 0.681358183 | 0.681358183 |
| 95 | 0.375519541; 0.376115439 | 2.56; 5.13 | 0.54340267 | 0.54340267 |
| 96 | 0.185936467; 0.376115439 | 33.33; 22.22 | 0.704110059 | 0.704110059 |
| 97 | 0.375519541; 0.375519541 | 0.67; 0.65 | 0.558359682 | 0.558359682 |
| 98 | NA | NA | 0.56685989 | 0.56685989 |
| 99 | 0.375519541; 0.375519541 | 1.47; 1.89 | 0.53718766 | 0.53718766 |
| 100 | 0.375519541; 0.376115439 | 17.65; 11.76 | 0.511127208 | 0.511127208 |
| 101 | 0.376115439; 0.376115439 | 4.55; 3.85 | 0.51729912 | 0.51729912 |
| 102 | 0.375519541; 0.376115439; 0.375519541; 0.376115439; 0.375519541 | 4.76; 7.94; 4; 6.67; 1.32 | 0.499796862 | 0.499796862 |
| 103 | 0.375519541; 0.376115439 | 4.35; 6.52 | 0.54284743 | 0.54284743 |
| 104 | 0.375519541; 0.376115439 | 5.56; 8.33 | 0.541515701 | 0.541515701 |
| 105 | 0.217379602 | 11.76 | 0.535653111 | 0.535653111 |
| 106 | 0.375519541; 0.376115439 | 11.11; 11.11 | 0.5892727 | 0.5892727 |
| 107 | 0.375519541; 0.376115439; 0.376115439 | 1.22; 2.44; 1.2 | 0.51370343 | 0.51370343 |
| 108 | 0.375519541; 0.375519541 | 13.64; 9.09 | 0.53237946 | 0.53237946 |
| 109 | 0.375519541; 0.375519541 | 13.64; 9.09 | 0.537399464 | 0.537399464 |
| 110 | 0.375519541; 0.376115439 | 2.1; 1.4 | 0.551147909 | 0.551147909 |
| 111 | 0.375519541; 0.376115439 | 3.45; 3.45 | 0.51123955 | 0.51123955 |
| 112 | 0.375519541; 0.376115439; 0.375519541; 0.376115439 | 10.42; 8.33; 7.14; 3.57 | 0.565781874 | 0.565781874 |
| 113 | 0.375519541; 0.376115439; 0.375519541; 0.376115439 | 0.88; 0.88; 0.88; 0.88 | 0.643607703 | 0.643607703 |
| 114 | 0.069549998; 0.376115439; 0.069549998; 0.376115439; 0.184244052; 0.376115439 | 33.33; 8.33; 22.73; 4.55; 17.86; 3.57 | 0.669167007 | 0.669167007 |
| 115 | 0.007721092; 0.376115439 | 100; 100 | 0.569124095 | 0.569124095 |
| 116 | 0.007721092; 0.376115439 | 100; 100 | 0.504949853 | 0.504949853 |
| 117 | 0.375519541; 0.376115439 | 2.96; 1.48 | 0.574029643 | 0.574029643 |
| 118 | 0.376115439; 0.376115439 | 4.17; 2.27 | 0.51834761 | 0.51834761 |
| 119 | NA | NA | 0.589448815 | 0.589448815 |
| 120 | 0.375519541; 0.375519541 | 6.25; 6.25 | 0.559224072 | 0.559224072 |

TABLE 4.a4

| | T | P.Value | adj.P.Val | B | FC | FC_1 | LS |
|---|---|---|---|---|---|---|---|
| 1 | 11.41870737 | 0.0000000852 | 0.00000896 | 8.502768427 | 1.426412758 | 1.426412758 | 1 |
| 2 | 11.44997197 | 0.0000000827 | 0.00000883 | 8.533074362 | 1.468235956 | 1.468235956 | 1 |
| 3 | 13.35488716 | 0.0000000148 | 0.00000349 | 10.24087961 | 1.410121014 | 1.410121014 | 1 |
| 4 | 5.995732933 | 0.000063 | 0.000599458 | 1.735098705 | 1.463525779 | 1.463525779 | 1 |
| 5 | 12.11509752 | 0.0000000442 | 0.00000625 | 9.159529569 | 1.462201779 | 1.462201779 | 1 |
| 6 | 6.872082789 | 0.0000173 | 0.00025065 | 3.070157579 | 1.414641614 | 1.414641614 | 1 |
| 7 | 7.910034004 | 0.00000426 | 0.0000997 | 4.516650735 | 1.41321087 | 1.41321087 | 1 |
| 8 | 8.959263256 | 0.00000117 | 0.000044 | 5.843091809 | 1.444399781 | 1.444399781 | 1 |
| 9 | 6.219486663 | 0.0000448 | 0.000471751 | 2.086224451 | 1.419808915 | 1.419808915 | 1 |
| 10 | 6.720085442 | 0.0000215 | 0.000289033 | 2.846273777 | 1.433432824 | 1.433432824 | 1 |
| 11 | 7.35826499 | 0.00000883 | 0.00015988 | 3.765261563 | 1.427926058 | 1.427926058 | 1 |
| 12 | 8.137081873 | 0.00000319 | 0.0000826 | 4.814738224 | 1.407311017 | 1.407311017 | 1 |
| 13 | 10.81146677 | 0.000000155 | 0.0000128 | 7.898019883 | 1.412940842 | 1.412940842 | 1 |
| 14 | 14.58929087 | 0.00000000570 | 0.00000418 | 11.13259491 | 1.507136465 | 1.507136465 | 1 |
| 15 | 12.77090209 | 0.0000000255 | 0.00000896 | 9.696346675 | 1.420964884 | 1.420964884 | 1 |
| 16 | 9.293886644 | 0.000000795 | 0.0000347 | 6.239911385 | 1.445972124 | 1.445972124 | 1 |
| 17 | 6.624725473 | 0.0000251 | 0.000578066 | 2.76246354 | 1.449616533 | 1.449616533 | 1 |

TABLE 4.a4-continued

| | T | P.Value | adj.P.Val | B | FC | FC_1 | LS |
|---|---|---|---|---|---|---|---|
| 18 | 8.382200009 | 0.00000235 | 0.0000683 | 5.129546721 | 1.474918169 | 1.474918169 | 1 |
| 19 | 7.979860208 | 0.00000399 | 0.000176719 | 4.646990654 | 1.452485141 | 1.452485141 | 1 |
| 20 | 10.10136035 | 0.000000325 | 0.0000199 | 7.149689173 | 1.496342976 | 1.496342976 | 1 |
| 21 | 6.688687973 | 0.0000229 | 0.000544563 | 2.856999798 | 1.456967492 | 1.456967492 | 1 |
| 22 | 8.134319545 | 0.0000032 | 0.0000828 | 4.811149443 | 1.409911765 | 1.409911765 | 1 |
| 23 | 7.900221709 | 0.00000442 | 0.000188752 | 4.542868458 | 1.474542679 | 1.474542679 | 1 |
| 24 | 6.947739296 | 0.0000159 | 0.000426833 | 3.234059599 | 1.423136515 | 1.423136515 | 1 |
| 25 | 3.331776907 | 0.006019015 | 0.025782104 | −2.830634507 | 1.428725328 | 1.428725328 | 1 |
| 26 | 7.104660514 | 0.0000128 | 0.000368882 | 3.457978296 | 1.472307095 | 1.472307095 | 1 |
| 27 | 6.228318665 | 0.0000443 | 0.000467151 | 2.099842796 | 1.469678494 | 1.469678494 | 1 |
| 28 | 12.67188628 | 0.0000000279 | 0.00000925 | 9.611921232 | 1.42017072 | 1.42017072 | 1 |
| 29 | 6.907694762 | 0.0000168 | 0.000443936 | 3.17637888 | 1.442083074 | 1.442083074 | 1 |
| 30 | 11.98944945 | 0.0000000496 | 0.00000664 | 9.043800442 | 1.435508789 | 1.435508789 | 1 |
| 31 | 5.855905908 | 0.0000781 | 0.000696337 | 1.512075209 | 1.408963936 | 1.408963936 | 1 |
| 32 | 11.91777496 | 0.000000053 | 0.00000684 | 8.977248932 | 1.460781455 | 1.460781455 | 1 |
| 33 | 15.57287232 | 0.00000000258 | 0.00000143 | 11.93541682 | 1.461504521 | 1.461504521 | 1 |
| 34 | 7.053243734 | 0.0000137 | 0.000387816 | 3.384978548 | 1.483511014 | 1.483511014 | 1 |
| 35 | 6.170784518 | 0.0000483 | 0.000496728 | 2.010401724 | 1.436640957 | 1.436640957 | 1 |
| 36 | 5.063978273 | 0.000279288 | 0.001735541 | 0.197313651 | 1.410763618 | 1.410763618 | 1 |
| 37 | 9.323393292 | 0.000000768 | 0.0000341 | 6.274327924 | 1.466864988 | 1.466864988 | 1 |
| 38 | 5.592169596 | 0.000118264 | 0.000931355 | 1.083895875 | 1.413597611 | 1.413597611 | 1 |
| 39 | 9.514080591 | 0.000000619 | 0.0000296 | 6.494550787 | 1.44738815 | 1.44738815 | 1 |
| 40 | 7.45936797 | 0.00000788 | 0.000271057 | 3.951910034 | 1.420811231 | 1.420811231 | 1 |
| 41 | 8.790634074 | 0.00000143 | 0.0000501 | 5.638482912 | 1.415066693 | 1.415066693 | 1 |
| 42 | 11.02640152 | 0.000000125 | 0.0000112 | 8.115640908 | 1.456662374 | 1.456662374 | 1 |
| 43 | 10.05471731 | 0.000000353 | 0.0000392 | 7.101969519 | 1.482869426 | 1.482869426 | 1 |
| 44 | 3.549463521 | 0.004032097 | 0.019123986 | −2.429239653 | 1.472471033 | 1.472471033 | 1 |
| 45 | 7.127692941 | 0.0000124 | 0.000361932 | 3.490562728 | 1.561712056 | 1.561712056 | 1 |
| 46 | 6.776432481 | 0.0000202 | 0.000503209 | 2.985756907 | 1.567542324 | 1.567542324 | 1 |
| 47 | 7.312780139 | 0.0000096 | 0.000307939 | 3.749817999 | 1.610982562 | 1.610982562 | 1 |
| 48 | 8.627862485 | 0.00000174 | 0.0000567 | 5.437954357 | 1.436072404 | 1.436072404 | 1 |
| 49 | 2.879175397 | 0.013870748 | 0.033607862 | −3.760402038 | 1.435842052 | 1.435842052 | 1 |
| 50 | 7.686493693 | 0.0000057 | 0.000120419 | 4.216916567 | 1.549979836 | 1.549979836 | 1 |
| 51 | 3.873638586 | 0.002219338 | 0.008089367 | −1.925126481 | 1.410351802 | 1.410351802 | 1 |
| 52 | 2.799977556 | 0.016065387 | 0.037943829 | −3.904564952 | 1.799607536 | 1.799607536 | 1 |
| 53 | 4.829381768 | 0.000418663 | 0.00396156 | −0.127073912 | 1.440761407 | 1.440761407 | 1 |
| 54 | 11.65995884 | 0.0000000676 | 0.00000784 | 8.734586918 | 1.51837676 | 1.51837676 | 1 |
| 55 | 6.719932103 | 0.0000215 | 0.000289074 | 2.846046312 | 1.437436864 | 1.437436864 | 1 |
| 56 | 7.205917646 | 0.0000109 | 0.000183806 | 3.550848217 | 1.407614809 | 1.407614809 | 1 |
| 57 | 9.703470008 | 0.000000502 | 0.0000259 | 6.709574897 | 1.410023926 | 1.410023926 | 1 |
| 58 | 10.42145474 | 0.00000024 | 0.0000316 | 7.489206383 | 1.45229061 | 1.45229061 | 1 |
| 59 | 14.29981241 | 0.00000000683 | 0.00000239 | 10.99743706 | 1.51759159 | 1.51759159 | 1 |
| 60 | 20.73578644 | 0.0000000000937 | 0.00000039 | 14.98984912 | 1.439893446 | 1.439893446 | 1 |
| 61 | 9.234179531 | 0.000000851 | 0.0000362 | 6.16998741 | 1.439482182 | 1.439482182 | 1 |
| 62 | 7.889911948 | 0.00000448 | 0.000190333 | 4.529331111 | 1.47201098 | 1.47201098 | 1 |
| 63 | 8.897471193 | 0.0000013 | 0.0000874 | 5.791565108 | 1.439256803 | 1.439256803 | 1 |
| 64 | 11.6462149 | 0.0000000685 | 0.00000792 | 8.721505014 | 1.538035387 | 1.538035387 | 1 |
| 65 | 6.080930527 | 0.0000562 | 0.000988559 | 1.935395629 | 1.599613111 | 1.599613111 | 1 |
| 66 | 13.56030744 | 0.000000013 | 0.000000631 | 10.34557005 | 1.445562123 | 1.445562123 | 1 |
| 67 | 9.911003735 | 0.0000004 | 0.0000225 | 6.941066482 | 1.450586165 | 1.450586165 | 1 |
| 68 | 8.045227884 | 0.00000367 | 0.000168145 | 4.731865147 | 1.493756752 | 1.493756752 | 1 |
| 69 | 7.253805221 | 0.0000104 | 0.000323479 | 3.667708828 | 1.419906087 | 1.419906087 | 1 |
| 70 | 8.402676813 | 0.00000235 | 0.000126478 | 5.186755121 | 1.443004952 | 1.443004952 | 1 |
| 71 | 7.591037902 | 0.00000647 | 0.000130639 | 4.08699801 | 1.407389118 | 1.407389118 | 1 |
| 72 | 14.65514231 | 0.00000000517 | 0.00000209 | 11.2681905 | 1.433173193 | 1.433173193 | 1 |
| 73 | 10.41656381 | 0.000000233 | 0.0000163 | 7.487562094 | 1.526374612 | 1.526374612 | 1 |
| 74 | 11.44449067 | 0.0000000862 | 0.0000169 | 8.505212327 | 1.48447368 | 1.48447368 | 1 |
| 75 | 9.311645565 | 0.000000802 | 0.0000646 | 6.276707204 | 1.421396141 | 1.421396141 | 1 |
| 76 | 15.47686276 | 0.00000000291 | 0.00000295 | 11.76272323 | 1.443423204 | 1.443423204 | 1 |
| 77 | 7.915322211 | 0.00000434 | 0.000186551 | 4.562672286 | 1.532363961 | 1.532363961 | 1 |
| 78 | 9.472837646 | 0.000000669 | 0.0000578 | 6.460535766 | 1.457837946 | 1.457837946 | 1 |
| 79 | 9.95953215 | 0.00000000379 | 0.0000218 | 6.99458501 | 1.466139089 | 1.466139089 | 1 |
| 80 | 10.50670556 | 0.00000022 | 0.00003 | 7.577414801 | 1.425494146 | 1.425494146 | 1 |
| 81 | 10.55449174 | 0.000000209 | 0.000029 | 7.626566681 | 1.522411225 | 1.522411225 | 1 |
| 82 | 5.940288146 | 0.0000627 | 0.001143512 | 1.71463084 | 1.450467388 | 1.450467388 | 1 |
| 83 | 7.028930184 | 0.0000142 | 0.000396157 | 3.350333903 | 1.474308937 | 1.474308937 | 1 |
| 84 | 10.64769999 | 0.000000184 | 0.0000142 | 7.729497708 | 1.42950416 | 1.42950416 | 1 |
| 85 | 7.903107235 | 0.0000044 | 0.000188471 | 4.546654942 | 1.440922398 | 1.440922398 | 1 |
| 86 | 5.619206152 | 0.000114904 | 0.001606096 | 1.200035669 | 1.475940644 | 1.475940644 | 1 |
| 87 | 10.57812691 | 0.000000197 | 0.0000149 | 7.657182201 | 1.430210401 | 1.430210401 | 1 |
| 88 | 13.55522334 | 0.0000000131 | 0.00000631 | 10.34151993 | 1.633886759 | 1.633886759 | 1 |
| 89 | 7.780242064 | 0.00000516 | 0.000208179 | 4.384499004 | 1.429109726 | 1.429109726 | 1 |
| 90 | 9.782590932 | 0.00000046 | 0.0000246 | 6.7983337 | 1.441017712 | 1.441017712 | 1 |
| 91 | 10.40776596 | 0.000000243 | 0.0000318 | 7.47498009 | 1.421794155 | 1.421794155 | 1 |
| 92 | 7.591517206 | 0.00000661 | 0.000240958 | 4.131679589 | 1.429341977 | 1.429341977 | 1 |
| 93 | 11.41759539 | 0.0000000853 | 0.00000896 | 8.501689081 | 1.522445121 | 1.522445121 | 1 |
| 94 | 2.6388933 | 0.021641591 | 0.048298429 | −4.195118121 | 1.603648753 | 1.603648753 | 1 |
| 95 | 10.63254592 | 0.000000193 | 0.0000277 | 7.706404143 | 1.457405833 | 1.457405833 | 1 |

TABLE 4.a4-continued

| | T | P.Value | adj.P.Val | B | FC | FC_1 | LS |
|---|---|---|---|---|---|---|---|
| 96 | 7.388506697 | 0.00000848 | 0.000155513 | 3.807459974 | 1.629139404 | 1.629139404 | 1 |
| 97 | 8.388740018 | 0.00000233 | 0.000068 | 5.137848331 | 1.472593953 | 1.472593953 | 1 |
| 98 | 19.080395 | 0.000000000262 | 0.00000103 | 13.93674337 | 1.481295932 | 1.481295932 | 1 |
| 99 | 7.477753822 | 0.00000752 | 0.000143556 | 3.931296311 | 1.451140955 | 1.451140955 | 1 |
| 100 | 6.947386003 | 0.0000156 | 0.000233679 | 3.179903542 | 1.425163271 | 1.425163271 | 1 |
| 101 | 8.48815395 | 0.00000212 | 0.000119002 | 5.293256553 | 1.431273241 | 1.431273241 | 1 |
| 102 | 8.595925108 | 0.00000181 | 0.0000579 | 5.39825467 | 1.414014449 | 1.414014449 | 1 |
| 103 | 5.759469074 | 0.0000922 | 0.001381184 | 1.426643373 | 1.456845039 | 1.456845039 | 1 |
| 104 | 7.831384519 | 0.00000483 | 0.000199439 | 4.452227696 | 1.455500869 | 1.455500869 | 1 |
| 105 | 11.64034791 | 0.0000000715 | 0.0000151 | 8.689620149 | 1.449598242 | 1.449598242 | 1 |
| 106 | 6.658579921 | 0.0000239 | 0.00056116 | 2.812571543 | 1.504488105 | 1.504488105 | 1 |
| 107 | 7.843278039 | 0.00000476 | 0.000197838 | 4.467931038 | 1.42771046 | 1.42771046 | 1 |
| 108 | 5.251373348 | 0.000204975 | 0.001381445 | 0.51621616 | 1.446312656 | 1.446312656 | 1 |
| 109 | 8.332012005 | 0.0000025 | 0.0000709 | 5.065672258 | 1.451354014 | 1.451354014 | 1 |
| 110 | 11.55832367 | 0.0000000773 | 0.000016 | 8.612768013 | 1.465251089 | 1.465251089 | 1 |
| 111 | 10.39410543 | 0.000000239 | 0.0000166 | 7.463794895 | 1.425274252 | 1.425274252 | 1 |
| 112 | 8.714863889 | 0.00000157 | 0.0000531 | 5.545510389 | 1.480189486 | 1.480189486 | 1 |
| 113 | 7.197536867 | 0.0000112 | 0.000340019 | 3.588934493 | 1.562230902 | 1.562230902 | 1 |
| 114 | 5.877052051 | 0.0000756 | 0.000680344 | 1.545980911 | 1.590154568 | 1.590154568 | 1 |
| 115 | 8.969566368 | 0.00000116 | 0.0000437 | 5.855491205 | 1.483622544 | 1.483622544 | 1 |
| 116 | 6.452593491 | 0.0000317 | 0.000372647 | 2.44450975 | 1.419074029 | 1.419074029 | 1 |
| 117 | 7.828142943 | 0.00000474 | 0.000106901 | 4.407574969 | 1.488675843 | 1.488675843 | 1 |
| 118 | 4.565789484 | 0.000656977 | 0.005449274 | −0.588131844 | 1.432313809 | 1.432313809 | 1 |
| 119 | 8.468189927 | 0.00000217 | 0.000120651 | 5.268466147 | 1.504671774 | 1.504671774 | 1 |
| 120 | 7.905614338 | 0.00000429 | 0.000100071 | 4.510785229 | 1.47347652 | 1.47347652 | 1 |

TABLE 4.a5

| | Loop Detected | Probe sequence 60 mer | Probe Location Chr |
|---|---|---|---|
| 1 | sHC | TCTCTTCTAAAGAATGTTAAATAAATATTCGAACATTCCAAAATGCAGAGATACTCATGG (SEQ ID NO: 2882) | 1 |
| 2 | sHC | TGTCTAAAAAGTAAAAAAGAATATTGGCTCGATGATACTTAAATTTTTGGTCAGAACAGG (SEQ ID NO: 2883) | 10 |
| 3 | sHC | AGCAGGAGGATCATCTGAGCTCAGTAGTTCGAACCTCATGTTTAGGGCCCAGCAAGTCCC (SEQ ID NO: 2884) | 12 |
| 4 | sHC | CAATAAAAATGAATGCTTAGTAAATCCATCGAGGCCGCAGTGAGCTATGACTGAGCCACC (SEQ ID NO: 2885) | 14 |
| 5 | sHC | GAGGCTGAGATATGAGGATCTCTTGAACTCGAATTCCAGTGTCTATAAATAAAGTTTTAT (SEQ ID NO: 2886) | 16 |
| 6 | sHC | TTGTCCTCATTATTATTCTTTCTAATACTCGAGATATAATTTACATATCATACAATTCAT (SEQ ID NO: 2887) | 2 |
| 7 | sHC | GGCCGGCAGATCACTTCAGGTCAAGAGTTCGACTTCCTTAAAGTTTCATTTTGATGAAGT (SEQ ID NO: 2888) | 21 |
| 8 | sHC | GGCCGGCAGATCACTTCAGGTCAAGAGTTCGATGATGATATAGGCATTAAAACATGAGTT (SEQ ID NO: 2889) | 21 |
| 9 | sHC | TTTTTATTTTATCTTTTATTTTATTTTTTCGAAGTATTACTATTCTCACTTTATAGATGA (SEQ ID NO: 2890) | 21 |
| 10 | sHC | GGCAGGTGAATCAGCTGAGTTCAGGAGTTCGATGTGGGTCTTGGAACATATCCCCTCCAG (SEQ ID NO: 2891) | 5 |
| 11 | sHC | GGCAGGTGAATCAGCTGAGTTCAGGAGTTCGATTCCACATAATCTCTTCCAAAAAGAAGA (SEQ ID NO: 2892) | 5 |
| 12 | sHC | GGCAGGTGAATCAGCTGAGTTCAGGAGTTCGATTAGCCCAGTATCTCATTGCTGTATCTT (SEQ ID NO: 2893) | 5 |
| 13 | sHC | CAAAGCTGAAAGCTTACACTTCATTGAATCGAAAATGCATTTCTTATGTTACTGTCTTGT (SEQ ID NO: 2894) | 8 |
| 14 | mHC | GTATCACCCCTGGCCATTACATTATCCATCGATAAGGATTCTATAGAGTCAGATTCTCTA (SEQ ID NO: 2895) | 1 |
| 15 | mHC | GTATCACCCCTGGCCATTACATTATCCATCGACCTCCCAAAGAGACAATTGTTTTTTAAA | 1 |

TABLE 4.a5-continued

| Loop Detected | Probe sequence 60 mer | Probe Location Chr |
|---|---|---|
| | (SEQ ID NO: 2896) | |
| 16 sHC | ATGTATTTTTCACAATATGAATTAAAAGTCGACTCATTTTCATCTGAAAAGCCTGTTTAG (SEQ ID NO: 1632) | 10 |
| 17 mHC | ATTACATTTCATATATTTCAGTCCATTTTCGAAATAATACAACCGTTTGTCTCTTATCTA (SEQ ID NO: 2898) | 10 |
| 18 sHC | CTTAAAGATAAACAATATGTGTATTAACTCGATGATATCTGCATTAATTTTTAAATTTGA (SEQ ID NO: 2899) | 11 |
| 19 mHC | TTCAACAGTCATACATATTTTAAAGAATTCGAAATAAGTTTTATTTTGATACTGATATAA (SEQ ID NO: 2900) | 15 |
| 20 sHC | AGCAGATGGATCACATGAGGTCAGGAGTTCGAACTTCTGACCTCAGGTGATACACCTGCC (SEQ ID NO: 2901) | 16 |
| 21 mHC | TTTAAAATTGTTGACAGAAAATATATTATCGATAACATCTTGACAGAGTTAAAGTTTCAA (SEQ ID NO: 2902) | 3 |
| 22 sHC | CTATTCTAAGGATATACTTGAACTATAATCGAATTATGTCTGCTTAAAAGTCTGGTACAA (SEQ ID NO: 2903) | 3 |
| 23 mHC | TGAAAATAAAAGATTATTTAATCAAGAATCGATATATTCTACAAACTGCTTTATTGTAGA (SEQ ID NO: 878) | 4 |
| 24 mHC | TTAAATGTACCAATCTTTTATTTTATAGTCGAGAAAAGTCTGAACTAAATCTGTTAAGGT (SEQ ID NO: 2905) | X |
| 25 mHC | TCAGAGTTGGAAGTACCCTTAAAGGCCATCGAGCGTTTTATGTGGACTCTCCTTTTTTCT (SEQ ID NO: 2906) | X |
| 26 mHC | ACAGGTATTAGGGTGTTTATTTTGCTTCTCGATTCAAAAGGGCAGATAATTTTGGAGCAA (SEQ ID NO: 2907) | 12 |
| 27 sHC | CAATAAAAATGAATGCTTAGTAAATCCATCGAGGCCGCAGTGAGCTATGACTGAGCCACC (SEQ ID NO: 2885) | 14 |
| 28 mHC | GAGGCGGGTGATTCACAAGGTCAGATGTTCGAAAATTAATTTTATGTCTGTGGCTTCTAA (SEQ ID NO: 2909) | 6 |
| 29 mHC | TTTTTAGTTTGATTATAGTTTATAATAATCGACTCTTTCCCAGTAATCTACTAGGTAATT (SEQ ID NO: 2910) | 3 |
| 30 sHC | AGTATATCTACAATACACATACTGTGAATCGAATGTTTCCCTGGGATTTTTGGACTTTCA (SEQ ID NO: 2911) | 15 |
| 31 sHC | AGCAGGTGGATCACCTGCGGTCAGGAGTTCGATGGGAAACTAATCAATAAGAAATTAGAT (SEQ ID NO: 2912) | 16 |
| 32 sHC | GAGTAATTCACCAAAGTCACAAATTCACTCGACACTCCAGAGATTGTGAATGTCCTTTTA (SEQ ID NO: 2913) | 9 |
| 33 sHC | TGTAAAGTTTTCATATATAAAATCAAATTCGACAACAGGGTAAGGGTTAGAACCCAAGTT (SEQ ID NO: 2914) | 6 |
| 34 mHC | TCTCAAAAAAAAAAAAAAAATTGGTGTCTCGAGGATGGGAGCGTTTCCATGGCAACTTGA (SEQ ID NO: 2915) | 8 |
| 35 sHC | ATGGGATGGATCACTTGAGATAAGGAGTTCGATGCTTGGAGCTGTAGAAGTAAACAGAGA (SEQ ID NO: 2916) | 10 |
| 36 sHC | GGCAGGTGGACAACCTGAGGTCAGGAGTTCGATCTCCTGACCTCATGATTCCCCTGCCTC (SEQ ID NO: 2917) | 15 |
| 37 sHC | TAAAATTTTTTTTAAGAAGAAAAAAGACTCGAAACCTCTTCCAGAAAAAAATACTAACGG (SEQ ID NO: 2918) | 16 |
| 38 sHC | AGCAGATGGATCACATGAGGTCAGGAGTTCGATCTCCTGACCTCAAGTGTTCCGCCCACC (SEQ ID NO: 2919) | 16 |
| 39 sHC | GCCAGGCAGATCATGTGAGATCAGGAGTTCGAACCCTCCCTTTGATCTATTCCATTCTCA (SEQ ID NO: 2920) | 19 |
| 40 mHC | AATGTTACTTATTATGATTATTAGATAATCGATAAATCTAACAATTTAGATAAAAATGGG (SEQ ID NO: 2921) | 20 |

TABLE 4.a5-continued

| Loop Detected | Probe sequence 60 mer | Probe Location Chr |
|---|---|---|
| 41 sHC | TTATCTTTATAAATCATACCATATAGCTTCGAGGAACTGATCTTTAATTTTTCTTTAATT (SEQ ID NO: 2922) | 20 |
| 42 sHC | AGAGCAATAATAATATCTATGACCAATATCGAACTCAGGGAAATTAATGTTTGAAGAGTT (SEQ ID NO: 2923) | 4 |
| 43 mHC | TGAAAATAAAAGATTATTTAATCAAGAATCGATTAGGATGGAGAATAGTAACACAAAATT (SEQ ID NO: 2924) | 4 |
| 44 mHC | CACACTTGAGCTCATTGTAAACCAAAGCTCGAGAGCGGTCCCGTGGGGGCGGTGTTACTC (SEQ ID NO: 200) | X |
| 45 mHC | CTGCAGGTGTGTGCATTAAGGAGCAACTTCGAACCAACGTTTCTTACAGTGGTCGGGGGA (SEQ ID NO: 2926) | 1 |
| 46 mHC | CTGCAGGTGTGTGCATTAAGGAGCAACTTCGAGATGGTTTATGAAACTTTAAGGAATTTT (SEQ ID NO: 2927) | 1 |
| 47 mHC | GCTATTTTTAGTGAGTGCCTGGGTATATTCGACAAAAACATACAGGCACCTGTGAGCTTT (SEQ ID NO: 2928) | X |
| 48 sHC | ATGCCATTCTTTTGTTTTCTTTTGTTTTTCGACTAGTCCTGATTTTGTACACATGAAAAT (SEQ ID NO: 2929) | 17 |
| 49 sHC | TTTTATGTATGATATTTGCGTGAGATTCTCGATTTCCACTTAGTACACACAGTGAAAGGG (SEQ ID NO: 2930) | 21 |
| 50 sHC | AGGTGGGTGGATCCACGATGTCAGGAGATCGATTGAGCTTAACAGCATAATTATTATTAG (SEQ ID NO: 2931) | 7 |
| 51 sHC | CTTCCAGTACCTGAGTCAGTCTGAGAAATCGAACTCCTGACCTCAGGCAGTCACCTTCTT (SEQ ID NO: 2932) | 5 |
| 52 sHC | TGTCTTGAGGCTTACTAGTGCACTCCCGTCGAATTATGTTTAAAGATGTAAATTATTATT (SEQ ID NO: 2933) | 7 |
| 53 mHC | GCTGAGAGTCAGGTGGACAGGACTCTCCTCGAAACTCTGCCTGTTTTTGCCTTTTACTTT (SEQ ID NO: 2934) | 8 |
| 54 sHC | TATTTGTAAATATTTTAGTATTTACAAATCGATTATGATAGTAGATTGTAGAAAAAACA (SEQ ID NO: 2935) | 8 |
| 55 sHC | CCTTATAATTTAGTTAATGAAAATATAATCGAATAAAGTATTCAGAAGTAAGCCTGGAAA (SEQ ID NO: 2936) | 9 |
| 56 sHC | TTCCACTCTGGAAAACATATCACTTCTCTCGATACCTATATTAAGAAAGAAGAAAGGTCT (SEQ ID NO: 2937) | X |
| 57 sHC | TTATCCATAACCATAAGATATTCTAAGATCGAATAGTGACACTTATGCAGAGGAGAGAAT (SEQ ID NO: 2938) | 18 |
| 58 mHC | TTTAGGAAGTTTTTTTATTATCATTTTTTCGAAACACCCGATTGTTTAAATTTTAATGAC (SEQ ID NO: 2939) | 10 |
| 59 sHC | CCTGTAAGATTCCATTTATACAACATTATCGAGCAATTCCACTATGGGTATATATCCAAA (SEQ ID NO: 2940) | 10 |
| 60 sHC | TCCTTGGATAGGACATTACATATCATTTTCGAGTAATATTAAAGATTCCAGGACTCACAA (SEQ ID NO: 1574) | 12 |
| 61 sHC | GTAGATATCCAAACATTTATGAAATTAATCGAGAACAAAAGGGCATAATGTATTATACGG (SEQ ID NO: 2942) | 12 |
| 62 mHC | TATGTATTTATATATGATTACCATTATGTCGAGATAGAGTATGTAATCATTTTATGATTT (SEQ ID NO: 2943) | 12 |
| 63 mHC | TTATATCAGTATCAAAATAAAACTTATTTCGATAAAAAATAATGAAACAAATGCTTTTGC (SEQ ID NO: 2944) | 15 |
| 64 sHC | TTTATTGATTTTTTACTATTTTTTTTTTTTCGAAATTCATCAGTACTTTGTAAAATGGAAT (SEQ ID NO: 2945) | 16 |
| 65 mHC | TGAGGCGGGTCTTTATCTCCACAGTGCCTCGAGCAAAAGCTTACTTTTTCAGAAAAGAAA (SEQ ID NO: 2946) | 2 |

TABLE 4.a5-continued

| Loop Detected | Probe sequence 60 mer | Probe Location Chr |
|---|---|---|
| 66 mHC | TTCTTGACTTTAATTAAAGTAGTTGTTCTCGAATGTGGAGCATCATTTGCATTTCTTTCT (SEQ ID NO: 2947) | 20 |
| 67 sHC | TAGTTAAAAGTGAAGAAAAGGAAACTTTTCGATGTACTTTTCCATTTGTTTACGTACATG (SEQ ID NO: 2948) | 3 |
| 68 mHC | TCTTTACTAAAGAGAATCTATCTTGTATTCGAATAAGATTATCTCCTTTATACATCTATT (SEQ ID NO: 2949) | 4 |
| 69 mHC | TGGCTGAATTAATTTTTTTAAACATGATTCGATCTAGAAATTCACAGGAAAATTTCTTGA (SEQ ID NO: 2950) | 6 |
| 70 mHC | TATTCATATAAGGAAAGAAAGAAAAATCTCGATCCATTTTTCCTTTCTTTATGTAACTGG (SEQ ID NO: 2951) | 6 |
| 71 sHC | CCTTATTTAAAAAGAAATATTAGGAATTTCGACACTATTATCTAAAGTATATTCCATACT (SEQ ID NO: 2952) | 7 |
| 72 sHC | ATGGTAAATGACTTGTATTTATTAGATATCGATTAGAACAGGAATCCTGTTTATGTTAAT (SEQ ID NO: 2953) | 8 |
| 73 sHC | TCTCTAAAAACAGAAATATCTTACTTTTTCGAAAAAGATATATAAAGCAATAATTAACAG (SEQ ID NO: 2954) | X |
| 74 mHC | TTTATTTTATTTTTATTATTTGAAATTCTCGAGAAGTTCTCTATATCCTAATTCCCCTCT (SEQ ID NO: 2955) | 10 |
| 75 mHC | AAGCATATATATATATTGAATAAGTGTCGATATAGACAATATGAAAACAGACTATATA (SEQ ID NO: 2956) | 4 |
| 76 mHC | GAGGCGGGTGATTCACAAGGTCAGATGTTCGATAATTCTGGATTTGAGCTTGTTACAGAT (SEQ ID NO: 2957) | 6 |
| 77 mHC | ATGCTAAATTATGTAAAATGGAATATGTTCGATTCTTATCAATTGAAGATTGAAAAGGTG (SEQ ID NO: 2958) | 5 |
| 78 mHC | AATGTAAAATATCACTAATATTTCTCTATCGATATGTAACATTGAACAGTTCCAAATGAG (SEQ ID NO: 2959) | 9 |
| 79 sHC | ACTTCATTTTTTATTTGAGATAGAGTCTCGACAGAACCTATACATATAACAGTGCATCT (SEQ ID NO: 2960) | X |
| 80 mHC | TTTAATGAATATTAAATAACAACAAATATCGAAGCATCCTGTAGTCTAAAAATAAACACT (SEQ ID NO: 2961) | 5 |
| 81 mHC | ATTTTTAATTTAATATTTGTTTTGTCTCTCGAAAACAGTGATTTTTGTAAAGGAAATATT (SEQ ID NO: 2962) | 6 |
| 82 mHC | TTTACTATTGAATAACTAATCAAATTCATCGAATATATCTATTACTCGCTGTACTAAAGG (SEQ ID NO: 2963) | 2 |
| 83 mHC | ATGAATTAAAAATATTCTTCAAATCTTATCGAACAGCTTATTTTTTCCTTGTATGACATA (SEQ ID NO: 2964) | 5 |
| 84 sHC | TTCTCATGTTTCTTTTTCTGACTAAATGTCGAATTAGTCTCTATTCTAGCTTTACTTGAG (SEQ ID NO: 2965) | 3 |
| 85 mHC | AATTCAGACCCCTGGTACTCAGGGGTCTTCGACAGCTGAGAGCAGTATTTAAAAATTTCT (SEQ ID NO: 2966) | 1 |
| 86 mHC | ATTATATATTCTAACTTGGAATTTTATTTCGACTGTATAATAAAACAGGACTTTTAGCAA (SEQ ID NO: 2967) | 1 |
| 87 sHC | GAAGCAGGCAGATCATGAGGTCAGAAGATCGATGGATGAATGGATAAACAAGATGTAGTG (SEQ ID NO: 2968) | 12 |
| 88 mHC | TTTTTCATCTATATTTATTCTACATAAATCGAATTCATCTATTTTCCACCATTATCTATC (SEQ ID NO: 2969) | 12 |
| 89 mHC | AATCCAGTTTTTGGTTTTGTTAGTAATCTCGATTATATAAATCCTAGCTAGCAGATAAAC (SEQ ID NO: 2970) | 13 |
| 90 sHC | AGTGTAGGAATGAAAACAAAAAGTAATGTCGAGTCATTAATTCTTGCTTCTTAACTGCTT (SEQ ID NO: 2971) | 2 |
| 91 mHC | TCATAATGAGTAACAATGTATAAAAAATATCGAAACCCTGCTTTATTTTATTTATTTTTTT | 20 |

TABLE 4.a5-continued

| Loop Detected | Probe sequence 60 mer | Probe Location Chr |
|---|---|---|
| | (SEQ ID NO: 2972) | |
| 92 mHC | TATTTTACAATAATCTTCTTAAGTAATGTCGAGTAAAATTTATGTTCCATGAAAAAAATC (SEQ ID NO: 2973) | 4 |
| 93 sHC | TTCATGAGTCATAGTCAATTATATAATCTCGATTACTCAGAGCTGTAAAATACCTTGGCT (SEQ ID NO: 2974) | 6 |
| 94 sHC | TGTCTTGAGGCTTACTAGTGCACTCCCGTCGATCAGAAGATATAAATCTGGGCCGAAGTA (SEQ ID NO: 2975) | 7 |
| 95 mHC | TAAGATTATAGAAGTTACAGTGCATACTTCGAACCCTTTTGTTTATAAGTATATTTGAGA (SEQ ID NO: 2976) | 8 |
| 96 sHC | TCTACTTGTGCACATAATTTAAATCATATCGAAGGAAAAAATTGATATACAGAATGAAGC (SEQ ID NO: 2977) | 2 |
| 97 sHC | GTCAGGCAGATCACTCTAGGTCAGGAGTTCGATGTCCCTGTCAGACCAGGACACGTGGGC (SEQ ID NO: 2978) | 19 |
| 98 mHC | ATTCTGAAGAATTATATAACCTGATATATCGATTCCCTTTCTTTCTTTATTCCATTAGTC (SEQ ID NO: 2979) | 5 |
| 99 sHC | AAGGCGGGTAGATCATGAGATCAAGAGATCGAATTTCTGAGCTCCAGCAATCCACCCATC (SEQ ID NO: 2980) | 10 |
| 100 sHC | TAACTTTTGTCCATGAATATATATACTTTCGATGATGTTCTATTAAGAACAGTGAAAGGG (SEQ ID NO: 2981) | 14 |
| 101 mHC | ATTGTTTAAGCCAGCCAGCCTATGGTATTCGATGTAGGTTCATCAATTGTAACAAATGTA (SEQ ID NO: 2982) | 17 |
| 102 sHC | GAGGCGGGTGATTCACAAGGTCAGATGTTCGAAGTAATATTTTAATTATTTAATAGTTTA (SEQ ID NO: 2983) | 6 |
| 103 mHC | TTAAAAAAGATTTAAAAAGTCAAAGAGTCGAAGTTATTAAATTTCCATCTAAAATTCCA (SEQ ID NO: 910) | 6 |
| 104 mHC | ATATGTAGATATATGTTTTCAAGCAATATCGAAAAATGACTTCAAAGTCATGGATTTCAC (SEQ ID NO: 2985) | 14 |
| 105 mHC | GTATCACCCCTGGCCATTACATTATCCATCGAACCAACTTCAAATAAGGCAAACACCAAG (SEQ ID NO: 2986) | 1 |
| 106 mHC | CCTTTCAAATTTAGATTTAAAATCTATTTCGAAGTGCTTCTTTTGCTCTTCAATGATTAA (SEQ ID NO: 2987) | 1 |
| 107 mHC | AACAATAGTGAACATGTATTGTTTATATTCGATTACTCTTCCAAGAAGCTTAGTTGTAAC (SEQ ID NO: 2988) | 18 |
| 108 sHC | CTATATTTATCTGTCCACATCAGTGTTATCGAACTCCTGACGTCAGGTGATCTACCTGCC (SEQ ID NO: 2989) | 3 |
| 109 sHC | GGCAGGTAGATCACCTGACGTCAGGAGTTCGATGTACTTTTCCATTTGTTTACGTACATG (SEQ ID NO: 2990) | 3 |
| 110 mHC | AACTCTGTATTTTCTTTTGTAAGATTCATCGAACATTCAAATTCCCTAAAGAAAAGAGAG (SEQ ID NO: 2991) | 4 |
| 111 sHC | TATTTTACAATAATCTTCTTAAGTAATGTCGAGTAAAATTTATGTTCCATGAAAAAAATC (SEQ ID NO: 2973) | 4 |
| 112 sHC | AGGAAATTATAATATTGTGATTAAAAGTTCGAAGAGTTAACTGTAACTTTGAGAAGTTAA (SEQ ID NO: 2993) | 8 |
| 113 mHC | CCTTATAATTTAGTTAATGAAAATATAATCGAAATGAATTACCCAAAGGGAAAATAAATG (SEQ ID NO: 2994) | 9 |
| 114 sHC | ATGCAGATATTTTTCAACCAAACGAGGATCGAGGCCGCAGTAAGCTGTGTTCACACCACT (SEQ ID NO: 2995) | 9 |
| 115 SHO | GACAGGTGGATCATCTAATGTCAGGAGTTCGATTTGCTATTTGGAGAGCAATGAAACTGA (SEQ ID NO: 2996) | X |
| 116 sHC | GACAGGTGGATCATCTAATGTCAGGAGTTCGACCCATCAGATGTTACTGAGGAAACACAG (SEQ ID NO: 2997) | X |

TABLE 4.a5-continued

| Loop Detected | Probe sequence 60 mer | Probe Location Chr |
|---|---|---|
| 117 sHC | AGGTGGGTGGATCCACGATGTCAGGAGATCGATCTGGATACACCTGGAAAGACCGTTATT (SEQ ID NO: 2998) | 7 |
| 118 mHC | CATTTAATAGATACTCAGTAAATGTTTGTCGATCTGTTAGTAAACAGTGTCTAGTAGTCA (SEQ ID NO: 2999) | 14 |
| 119 mHC | TATATACATATTTTTAAGAAAAACAGTATCGATGAAGCAATATTCTTCCATCTTCAATTT (SEQ ID NO: 3000) | 2 |
| 120 sHC | AGATTACTCAAAAATTTTTTTAGAATTCTCGATTCTTATATGATATACATCTCTCCTGGA (SEQ ID NO: 3001) | 2 |

TABLE 4.a6

| | Probe Location | | | | 4 kb Sequence Location | | | | |
|---|---|---|---|---|---|---|---|---|---|
| | Start1 | End1 | Start2 | End2 | Chr | Start1 | End1 | Start2 | End2 |
| 1 | 58854203 | 58854234 | 58918114 | 58918145 | 1 | 58850233 | 58854234 | 58918114 | 58922115 |
| 2 | 114879815 | 114879846 | 114930122 | 114930153 | 10 | 114879815 | 114883816 | 114930122 | 114934123 |
| 3 | 109687914 | 109687945 | 109761674 | 109761705 | 12 | 109687914 | 109691915 | 109761674 | 109765675 |
| 4 | 64426803 | 64426834 | 64462354 | 64462385 | 14 | 64426803 | 64430804 | 64462354 | 64466355 |
| 5 | 23216838 | 23216869 | 23283304 | 23283335 | 16 | 23216838 | 23220839 | 23279334 | 23283335 |
| 6 | 26843104 | 26843135 | 26900262 | 26900293 | 2 | 26839134 | 26843135 | 26900262 | 26904263 |
| 7 | 17392864 | 17392895 | 17435717 | 17435748 | 21 | 17388894 | 17392895 | 17431747 | 17435748 |
| 8 | 17392864 | 17392895 | 17439402 | 17439433 | 21 | 17388894 | 17392895 | 17435432 | 17439433 |
| 9 | 17393292 | 17393323 | 17441050 | 17441081 | 21 | 17393292 | 17397293 | 17441050 | 17445051 |
| 10 | 56140829 | 56140860 | 56168655 | 56168686 | 5 | 56136859 | 56140860 | 56168655 | 56172656 |
| 11 | 56140829 | 56140860 | 56182062 | 56182093 | 5 | 56136859 | 56140860 | 56178092 | 56182093 |
| 12 | 56140829 | 56140860 | 56232409 | 56232440 | 5 | 56136859 | 56140860 | 56228439 | 56232440 |
| 13 | 28430371 | 28430402 | 28471461 | 28471492 | 8 | 28426401 | 28430402 | 28471461 | 28475462 |
| 14 | 110141802 | 110141833 | 110164010 | 110164041 | 1 | 110141802 | 110145803 | 110160040 | 110164041 |
| 15 | 110164010 | 110164041 | 110260665 | 110260696 | 1 | 110160040 | 110164041 | 110256695 | 110260696 |
| 16 | 121570719 | 121570750 | 121596903 | 121596934 | 10 | 121566749 | 121570750 | 121592933 | 121596934 |
| 17 | 127007 | 127038 | 183730 | 183761 | 10 | 127007 | 131008 | 179760 | 183761 |
| 18 | 98957049 | 98957080 | 99022282 | 99022313 | 11 | 98953079 | 98957080 | 99018312 | 99022313 |
| 19 | 91096267 | 91096298 | 91165754 | 91165785 | 15 | 91096267 | 91100268 | 91161784 | 91165785 |
| 20 | 27288253 | 27288284 | 27358113 | 27358144 | 16 | 27284283 | 27288284 | 27358113 | 27362114 |
| 21 | 107626100 | 107626131 | 107703592 | 107703623 | 3 | 107626100 | 107630101 | 107703592 | 107707593 |
| 22 | 120821865 | 120821896 | 120858831 | 120858862 | 3 | 120817895 | 120821896 | 120858831 | 120862832 |
| 23 | 37845589 | 37845620 | 37862832 | 37862863 | 4 | 37845589 | 37849590 | 37862832 | 37866833 |
| 24 | 130766459 | 130766490 | 130793708 | 130793739 | X | 130762489 | 130766490 | 130793708 | 130797709 |
| 25 | 68921047 | 68921078 | 68947630 | 68947661 | X | 68917077 | 68921078 | 68943660 | 68947661 |
| 26 | 54591576 | 54591607 | 54654414 | 54654445 | 12 | 54587606 | 54591607 | 54654414 | 54658415 |
| 27 | 64426803 | 64426834 | 64462354 | 64462385 | 14 | 64426803 | 64430804 | 64462354 | 64466355 |
| 28 | 151449133 | 151449164 | 151566571 | 151566602 | 6 | 151445163 | 151449164 | 151562601 | 151566602 |
| 29 | 85660887 | 85660918 | 85682353 | 85682384 | 3 | 85660887 | 85664888 | 85682353 | 85686354 |
| 30 | 97699356 | 97699387 | 97751925 | 97751956 | 15 | 97695386 | 97699387 | 97751925 | 97755926 |
| 31 | 15159367 | 15159398 | 15200610 | 15200641 | 16 | 15155397 | 15159398 | 15200610 | 15204611 |
| 32 | 89728565 | 89728596 | 89805232 | 89805263 | 9 | 89728565 | 89732566 | 89805232 | 89809233 |
| 33 | 82035912 | 82035943 | 82086732 | 82086763 | 6 | 82035912 | 82039913 | 82086732 | 82090733 |
| 34 | 11765160 | 11765191 | 11857514 | 11857545 | 8 | 11761190 | 11765191 | 11857514 | 11861515 |
| 35 | 14257097 | 14257128 | 14333977 | 14334008 | 10 | 14253127 | 14257128 | 14330007 | 14334008 |
| 36 | 26047414 | 26047445 | 26074632 | 26074663 | 15 | 26043444 | 26047445 | 26070662 | 26074663 |
| 37 | 11954547 | 11954578 | 11996894 | 11996925 | 7 | 11950577 | 11954578 | 11996894 | 12000895 |
| 38 | 27236516 | 27236547 | 27288253 | 27288284 | 16 | 27236516 | 27240517 | 27284283 | 27288284 |
| 39 | 48817066 | 48817097 | 48918494 | 48918525 | 19 | 48817066 | 48821067 | 48918494 | 48922495 |
| 40 | 20006512 | 20006543 | 20078974 | 20079005 | 20 | 20002542 | 20006543 | 20078974 | 20082975 |
| 41 | 21487530 | 21487561 | 21499599 | 21499630 | 20 | 21483560 | 21487561 | 21495629 | 21499630 |
| 42 | 166286147 | 166286178 | 166311616 | 166311647 | 4 | 166282177 | 166286178 | 166311616 | 166315617 |
| 43 | 37845589 | 37845620 | 37859966 | 37859997 | 4 | 37845589 | 37849590 | 37859966 | 37863967 |
| 44 | 115875719 | 115875750 | 115945548 | 115945579 | X | 115875719 | 115879720 | 115941578 | 115945579 |
| 45 | 48539737 | 48539768 | 48618802 | 48618833 | 1 | 48535767 | 48539768 | 48618802 | 48622803 |
| 46 | 48539737 | 48539768 | 48625938 | 48625969 | 1 | 48535767 | 48539768 | 48621968 | 48625969 |
| 47 | 6219982 | 6220013 | 6302811 | 6302842 | X | 6219982 | 6223983 | 6298841 | 6302842 |
| 48 | 35163743 | 35163774 | 35189737 | 35189768 | 17 | 35163743 | 35167744 | 35185767 | 35189768 |
| 49 | 29891288 | 29891319 | 29934336 | 29934367 | 21 | 29891288 | 29895289 | 29934336 | 29938337 |
| 50 | 36953187 | 36953218 | 36976432 | 36976463 | 7 | 36953187 | 36957188 | 36976432 | 36980433 |
| 51 | 56056790 | 56056821 | 56069488 | 56069519 | 5 | 56056790 | 56060791 | 56069488 | 56073489 |
| 52 | 22396847 | 22396878 | 22494715 | 22494746 | 7 | 22392877 | 22396878 | 22494715 | 22498716 |
| 53 | 122799764 | 122799795 | 122834548 | 122834579 | 8 | 122799764 | 122803765 | 122834548 | 122838549 |
| 54 | 13602479 | 13602510 | 13632064 | 13632095 | 8 | 13602479 | 13606480 | 13632064 | 13636065 |

TABLE 4.a6-continued

| | Probe Location | | | | 4 kb Sequence Location | | | |
|---|---|---|---|---|---|---|---|---|
| | Start1 | End1 | Start2 | End2 | Chr | Start1 | End1 | Start2 | End2 |
| 55 | 114547520 | 114547551 | 114640305 | 114640336 | 9 | 114547520 | 114551521 | 114636335 | 114640336 |
| 56 | 129690691 | 129690722 | 129712806 | 129712837 | X | 129686721 | 129690722 | 129712806 | 129716807 |
| 57 | 58181079 | 58181110 | 58205063 | 58205094 | 18 | 58181079 | 58185080 | 58201093 | 58205094 |
| 58 | 3728370 | 3728401 | 3766614 | 3766645 | 10 | 3728370 | 3732371 | 3766614 | 3770615 |
| 59 | 86379474 | 86379505 | 86449156 | 86449187 | 10 | 86379474 | 86383475 | 86445186 | 86449187 |
| 60 | 10186674 | 10186705 | 10224399 | 10224430 | 12 | 10186674 | 10190675 | 10220429 | 10224430 |
| 61 | 82971707 | 82971738 | 83013222 | 83013253 | 12 | 82971707 | 82975708 | 83009252 | 83013253 |
| 62 | 83942863 | 83942894 | 83954032 | 83954063 | 12 | 83938893 | 83942894 | 83954032 | 83958033 |
| 63 | 91096267 | 91096298 | 91157513 | 91157544 | 15 | 91096267 | 91100268 | 91157513 | 91161514 |
| 64 | 10002949 | 10002980 | 10049364 | 10049395 | 16 | 10002949 | 10006950 | 10045394 | 10049395 |
| 65 | 79971406 | 79971437 | 79981700 | 79981731 | 2 | 79967436 | 79971437 | 79981700 | 79985701 |
| 66 | 10252796 | 10252827 | 10337815 | 10337846 | 20 | 10248826 | 10252827 | 10333845 | 10337846 |
| 67 | 159122585 | 159122616 | 159171258 | 159171289 | 3 | 159122585 | 159126586 | 159171258 | 159175259 |
| 68 | 125303537 | 125303568 | 125344175 | 125344206 | 4 | 125299567 | 125303568 | 125344175 | 125348176 |
| 69 | 41262229 | 41262260 | 41314380 | 41314411 | 6 | 41258259 | 41262260 | 41310410 | 41314411 |
| 70 | 5723608 | 5723639 | 5777459 | 5777490 | 6 | 5723608 | 5727609 | 5773489 | 5777490 |
| 71 | 69585104 | 69585135 | 69650595 | 69650626 | 7 | 69585104 | 69589105 | 69646625 | 69650626 |
| 72 | 93946017 | 93946048 | 93987890 | 93987921 | 8 | 93942047 | 93946048 | 93983920 | 93987921 |
| 73 | 118654955 | 118654986 | 118719838 | 118719869 | X | 118654955 | 118658956 | 118719838 | 118723839 |
| 74 | 62722126 | 62722157 | 62762850 | 62762881 | 10 | 62722126 | 62726127 | 62762850 | 62766851 |
| 75 | 114660322 | 114660353 | 114716510 | 114716541 | 4 | 114660322 | 114664323 | 114712540 | 114716541 |
| 76 | 151449133 | 151449164 | 151468540 | 151468571 | 6 | 151445163 | 151449164 | 151468540 | 151472541 |
| 77 | 42385888 | 42385919 | 42426661 | 42426692 | 5 | 42381918 | 42385919 | 42422691 | 42426692 |
| 78 | 125047796 | 125047827 | 125098545 | 125098576 | 9 | 125043826 | 125047827 | 125094575 | 125098576 |
| 79 | 44203586 | 44203617 | 44239491 | 44239522 | X | 44199616 | 44203617 | 44235521 | 44239522 |
| 80 | 141308791 | 141308822 | 141343213 | 141343244 | 5 | 141308791 | 141312792 | 141339243 | 141343244 |
| 81 | 28494470 | 28494501 | 28536924 | 28536955 | 6 | 28490500 | 28494501 | 28536924 | 28540925 |
| 82 | 68188547 | 68188578 | 68261564 | 68261595 | 2 | 68188547 | 68192548 | 68257594 | 68261595 |
| 83 | 162107624 | 162107655 | 162154110 | 162154141 | 5 | 162107624 | 162111625 | 162154110 | 162158111 |
| 84 | 63282250 | 63282281 | 63329745 | 63329776 | 3 | 63278280 | 63282281 | 63325775 | 63329776 |
| 85 | 203216286 | 203216317 | 203265130 | 203265161 | 1 | 203216286 | 203220287 | 203265130 | 203269131 |
| 86 | 208035294 | 208035325 | 208092230 | 208092261 | 1 | 208031324 | 208035325 | 208092230 | 208096231 |
| 87 | 123047865 | 123047896 | 123114063 | 123114094 | 12 | 123043895 | 123047896 | 123110093 | 123114094 |
| 88 | 22550236 | 22550267 | 22591468 | 22591499 | 12 | 22550236 | 22554237 | 22587498 | 22591499 |
| 89 | 52988952 | 52988983 | 53036652 | 53036683 | 13 | 52984982 | 52988983 | 53032682 | 53036683 |
| 90 | 11504797 | 11504828 | 11532162 | 11532193 | 2 | 11504797 | 11508798 | 11532162 | 11536163 |
| 91 | 38210518 | 38210549 | 38329699 | 38329730 | 20 | 38210518 | 38214519 | 38329699 | 38333700 |
| 92 | 187960515 | 187960546 | 188019077 | 188019108 | 4 | 187956545 | 187960546 | 188015107 | 188019108 |
| 93 | 154259046 | 154259077 | 154298459 | 154298490 | 6 | 154259046 | 154263047 | 154294489 | 154298490 |
| 94 | 22365643 | 22365674 | 22396847 | 22396878 | 7 | 22365643 | 22369644 | 22392877 | 22396878 |
| 95 | 52230322 | 52230353 | 52253135 | 52253166 | 8 | 52230322 | 52234323 | 52249165 | 52253166 |
| 96 | 77486990 | 77486991 | 77514867 | 77514898 | 2 | 77482990 | 77486991 | 77514867 | 77518868 |
| 97 | 9846242 | 9846273 | 9871036 | 9871067 | 19 | 9846242 | 9850243 | 9867066 | 9871067 |
| 98 | 17887397 | 17887428 | 17964289 | 17964320 | 5 | 17887397 | 17891398 | 17964289 | 17968290 |
| 99 | 30527367 | 30527398 | 30585089 | 30585120 | 10 | 30527367 | 30531368 | 30585089 | 30589090 |
| 100 | 68255587 | 68255618 | 68325745 | 68325776 | 14 | 68255587 | 68259588 | 68325745 | 68329746 |
| 101 | 35289043 | 35289074 | 35315930 | 35315961 | 17 | 35285073 | 35289074 | 35311960 | 35315961 |
| 102 | 151387953 | 151387984 | 151449133 | 151449164 | 6 | 151387953 | 151391954 | 151445163 | 151449164 |
| 103 | 169187906 | 169187937 | 169230654 | 169230685 | 6 | 169183936 | 169187937 | 169230654 | 169234655 |
| 104 | 51892245 | 51892276 | 51939308 | 51939339 | 14 | 51888275 | 51892276 | 51935338 | 51939339 |
| 105 | 110164010 | 110164041 | 110187380 | 110187411 | 1 | 110160040 | 110164041 | 110183410 | 110187411 |
| 106 | 76048774 | 76048805 | 76098903 | 76098934 | 1 | 76048774 | 76052775 | 76094933 | 76098934 |
| 107 | 23965423 | 23965454 | 24007739 | 24007770 | 18 | 23965423 | 23969424 | 24003769 | 24007770 |
| 108 | 159142637 | 159142668 | 159171227 | 159171258 | 3 | 159142637 | 159146638 | 159167257 | 159171258 |
| 109 | 159142637 | 159142668 | 159171258 | 159171289 | 3 | 159142637 | 159146638 | 159171258 | 159175259 |
| 110 | 152218333 | 152218364 | 152243834 | 152243865 | 4 | 152214363 | 152218364 | 152243834 | 152247835 |
| 111 | 187960515 | 187960546 | 188019077 | 188019108 | 4 | 187956545 | 187960546 | 188015107 | 188019108 |
| 112 | 65608206 | 65608237 | 65633322 | 65633353 | 8 | 65604236 | 65608237 | 65633322 | 65637323 |
| 113 | 114559604 | 114559635 | 114640305 | 114640336 | 9 | 114559604 | 114563605 | 114636335 | 114640336 |
| 114 | 33275144 | 33275175 | 33317596 | 33317627 | 9 | 33271174 | 33275175 | 33317596 | 33321597 |
| 115 | 40499056 | 40499087 | 40520869 | 40520900 | X | 40495086 | 40499087 | 40520869 | 40524870 |
| 116 | 40499056 | 40499087 | 40522127 | 40522158 | X | 40495086 | 40499087 | 40518157 | 40522158 |
| 117 | 36953187 | 36953218 | 36980351 | 36980382 | 7 | 36953187 | 36957188 | 36980351 | 36984352 |
| 118 | 91001527 | 91001558 | 91060989 | 91061020 | 14 | 91001527 | 91005528 | 91060989 | 91064990 |
| 119 | 167702360 | 167702391 | 167773293 | 167773324 | 2 | 167702360 | 167706361 | 167769323 | 167773324 |
| 120 | 44766242 | 44766273 | 44792801 | 44792832 | 2 | 44766242 | 44770243 | 44788831 | 44792832 |

TABLE 4.a7

| | | PCR- | |
|---|---|---|---|
| | Probe | Primer1_ID | PCR_Primer1 |
| 1 | ORF1_1_58851578_58854234_58918114_58921170_FR | OBD159_2229 | ATCAGGCGTGCTTGTGAGGTTGTGC |

TABLE 4.a7-continued

| Probe | PCR-Primer1_ID | PCR_Primer1 |
|---|---|---|
| | | (SEQ ID NO: 3002) |
| 2 ORF1_10_114879815_114883799_114930122_114938828_RR | OBD159_2233 | GAAAATCCCTTGAGCCTCGGAGC |
| | | (SEQ ID NO: 3003) |
| 3 ORF1_12_109687914_109689169_109761674_109764027_RR | OBD159_2237 | CCCAGCACTTTGGTAATCCCAGC |
| | | (SEQ ID NO: 3004) |
| 4 ORF1_14_64426803_64429125_64462354_64463999_RR | OBD159_2241 | ACTTTATCTTGTAGAGACACGGCTAT |
| | | (SEQ ID NO: 3005) |
| 5 ORF1_16_23216838_23220910_23281989_23283335_RF | OBD159_2245 | GGTGAAACCCCATCTCTACCAAA |
| | | (SEQ ID NO: 3006) |
| 6 ORF1_2_26839991_26843135_26900262_26907333_FR | OBD159_2249 | GCTCAGTAAAGCCCTGTGTTGTGGAA |
| | | (SEQ ID NO: 3007) |
| 7 ORF1_21_17391129_17392895_17434190_17435748_FF | OBD159_2253 | CGCCTGTAATCCCACCACTTTGG |
| | | (SEQ ID NO: 3008) |
| 8 ORF1_21_17391129_17392895_17437778_17439433_FF | OBD159_2257 | CGCCTGTAATCCCACCACTTTGG |
| | | (SEQ ID NO: 3008) |
| 9 ORF1_21_17393292_17394472_17441050_17442330_RR | OBD159_2261 | TACCAGGGCTGAGGGTGTTGTCCTAT |
| | | (SEQ ID NO: 766) |
| 10 ORF1_5_56137297_56140860_56168655_56170386_FR | OBD159_2265 | TGTATGTGTGGCTGGGCGTAGTG |
| | | (SEQ ID NO: 3011) |
| 11 ORF1_5_56137297_56140860_56180306_56182093_FF | OBD159_2269 | TGCCAGTAATCCCAGAACTTTGG |
| | | (SEQ ID NO: 3012) |
| 12 ORF1_5_56137297_56140860_56230314_56232440_FF | OBD159_2273 | TGTATGTGTGGCTGGGCGTAGTGGTT |
| | | (SEQ ID NO: 3013) |
| 13 ORF1_8_28429398_28430402_28471461_28475878_FR | OBD159_2277 | TCCAAAGTGCTGGGATTACAGGC |
| | | (SEQ ID NO: 3014) |
| 14 ORF10_1_110141802_110145853_110155952_110164041_RF | OBD159_2281 | GCATAAAAGAGCCACCTGCCAGC |
| | | (SEQ ID NO: 3015) |
| 15 ORF10_1_110155952_110164041_110258457_110260696_FF | OBD159_2285 | TCCAGCATAAAAGAGCCACCTGCCAG |
| | | (SEQ ID NO: 3016) |
| 16 ORF10_10_121564423_121570750_121595209_121596934_FF | OBD159_2289 | GGAGAAGGTTCCAGAAGCCGCCT |
| | | (SEQ ID NO: 1742) |
| 17 ORF10_10_127007_130384_175918_183761_RF | OBD159_2293 | TTCCCATCCTCTGCTATTTGGTTACC |
| | | (SEQ ID NO: 3018) |
| 18 ORF10_11_98953280_98957080_99019353_99022313_FF | OBD159_2297 | GAACTACTTCACGGGAGAGATTACTC |
| | | (SEQ ID NO: 3019) |
| 19 ORF10_15_91096267_91099737_91157513_91165785_RF | OBD159_2301 | ATTGTCTTCCATTTTCTTCTGCTTA |
| | | (SEQ ID NO: 3020) |
| 20 ORF10_16_27283060_27288284_27358113_27360574_FR | OBD159_2305 | GGCATTCTGAGGGCAAGAGGTGTG |
| | | (SEQ ID NO: 3021) |
| 21 ORF10_3_107626100_107637571_107703592_107708851_RR | OBD159_2309 | TTTTGTCATTATTTGGTCATTTCAC |
| | | (SEQ ID NO: 3022) |
| 22 ORF10_3_120814252_120821896_120858831_120873172_FR | OBD159_2313 | GCTAACAGGACACACCCAGTGCC |
| | | (SEQ ID NO: 3023) |
| 23 ORF10_4_37845589_37847420_37862832_37864637_RR | OBD159_2317 | TGCCACAGCAAGTCTATCAGCATCCG |
| | | (SEQ ID NO: 952) |
| 24 ORF10_X_130763205_130766490_130793708_130805512_FR | OBD159_2321 | ACTTGTCTTTTCTCATTCTCTAACA |
| | | (SEQ ID NO: 3025) |
| 25 ORF10_X_68908108_68921078_68942609_68947661_FF | OBD159_2325 | TAGCCTGTTCCTGCCCCTCTCTG |
| | | (SEQ ID NO: 3026) |
| 26 ORF100_12_54589309_54591607_54654414_54660876_FR | OBD159_2329 | TAACCCTCACAACCACCCAGGAG |
| | | (SEQ ID NO: 3027) |

TABLE 4.a7-continued

| Probe | PCR-Primer1_ID | PCR_Primer1 |
|---|---|---|
| 27 ORF101_14_64426803_64429125_64462354_64463999_RR | OBD159_2241 | ACTTTATCTTGTAGAGACACGGCTAT (SEQ ID NO: 3005) |
| 28 ORF104_6_151443530_151449164_151559030_151566602_FF | OBD159_2333 | CGCCTGTAACCCCAGCATTTTGG (SEQ ID NO: 940) |
| 29 ORF105_3_85660887_85666710_85682353_85685845_RR | OBD159_2337 | GAATAACCCAAGTTCACAGCAATGGT (SEQ ID NO: 3030) |
| 30 ORF106_15_97695238_97699387_97751925_97755483_FR | OBD159_2341 | CAACTGACATCTTTCAACTCTGGGAG (SEQ ID NO: 3031) |
| 31 ORF106_16_15155840_15159398_15200610_15205140_FR | OBD159_2345 | GAGAGCGTTGGGCTTTGTCCAGC (SEQ ID NO: 3032) |
| 32 ORF107_9_89728565_89736522_89805232_89809003_RR | OBD159_2349 | CTATTCACCTTGACTTTGGCAGCACT (SEQ ID NO: 3033) |
| 33 ORF109_6_82035912_82039349_82086732_82090252_RR | OBD159_2353 | CACTAAGGGTCTGTCACTGAAAGGCT (SEQ ID NO: 3034) |
| 34 ORF109_8_11762928_11765191_11857514_11859558_FR | OBD159_2357 | CTGGGCAACAGTGCGAGACTCTG (SEQ ID NO: 3035) |
| 35 ORF11_10_14255629_14257128_14331424_14334008_FF | OBD159_2361 | AGTGGCTCACACCTGTAATCCCG (SEQ ID NO: 3036) |
| 36 ORF11_15_26044519_26047445_26072122_26074663_FF | OBD159_2365 | TAATACCAGCACTTTGGGAGGCT (SEQ ID NO: 3037) |
| 37 ORF11_16_11953475_11954578_11996894_11999391_FR | OBD159_2369 | AGCCTGGGTGACAGAGTAAGACT (SEQ ID NO: 3038) |
| 38 ORF11_16_27236516_27245702_27283060_27288284_RF | OBD159_2373 | ATTCTGAGGGCAAGAGGTGTGAGA (SEQ ID NO: 3039) |
| 39 ORF11_19_48817066_48819208_48918494_48922385_RR | OBD159_2377 | AGCCTGGGCAACAGAGTGAGACT (SEQ ID NO: 3040) |
| 40 ORF11_20_20005082_20006543_20078974_20082009_FR | OBD159_2381 | CAGGCACCACACCACAAGCACTG (SEQ ID NO: 3041) |
| 41 ORF11_20_21483562_21487561_21497814_21499630_FF | OBD159_2385 | AAGAAGGCTGGGTGTCCAAGCAG (SEQ ID NO: 3042) |
| 42 ORF11_4_166285010_166286178_166311616_166318662_FR | OBD159_2389 | CGTGCCCAGCCAAGATGACTTTT (SEQ ID NO: 3043) |
| 43 ORF11_4_37845589_37847420_37859966_37862832_RR | OBD159_2393 | TCTGCCACAGCAAGTCTATCAGCATC (SEQ ID NO: 3044) |
| 44 ORF11_X_115875719_115878414_115936015_115945579_RF | OBD159_2397 | CAGGAATCATTTGACACAATCCCC (SEQ ID NO: 260) |
| 45 ORF110_1_48532003_48539768_48618802_48625969_FR | OBD159_2401 | AAAGGTTCTTGCCACATTCCGCCCCA (SEQ ID NO: 3046) |
| 46 ORF111_1_48532003_48539768_48618802_48625969_FF | OBD159_2405 | TTCTTGCCACATTCCGCCCCAGC (SEQ ID NO: 3047) |
| 47 ORF112_X_6219982_6227001_6295729_6302842_RF | OBD159_2409 | GAGTTGGCAGGGAAATGGACAAGGT C (SEQ ID NO: 3048) |
| 48 ORF113_17_35163743_35164806_35182581_35189768_RF | OBD159_2413 | AAGCCTTCCCACAAAGAAAACTCAGG (SEQ ID NO: 3049) |
| 49 ORF114_21_29891288_29892971_29934336_29938623_RR | OBD159_2417 | CTTGGCTGCCTTCCTACACAGGGTAT (SEQ ID NO: 3050) |
| 50 ORF115_7_36953187_36955186_36976432_36980351_RR | OBD159_2421 | GTCAAGAGAGGCACGGTGGCTCA (SEQ ID NO: 3051) |
| 51 ORF117_5_56056790_56059051_56069488_56074299_RR | OBD159_2425 | GCGAGTTTGCCTGGTGGTCTCTC (SEQ ID NO: 3052) |
| 52 ORF117_7_22390272_22396878_22494715_22499120_FR | OBD159_2429 | AGGCTCCTGGGTTCCTATGTTCAAAT (SEQ ID NO: 3053) |

TABLE 4.a7-continued

| Probe | PCR-Primer1_ID | PCR_Primer1 |
|---|---|---|
| 53 ORF117_8_122799764_122802282_122834548_122836477_RR | OBD159_2433 | CTCCTACAAAGCAAAGGCTGAGG (SEQ ID NO: 3054) |
| 54 ORF117_8_13602479_13607345_13632064_13635521_RR | OBD159_2437 | ATACAGCCACTTCAACTTGTCCTAAT (SEQ ID NO: 242) |
| 55 ORF118_9_114547520_114550346_114637124_114640336_RF | OBD159_2441 | AGAAGAGATTGATAAGGTTGTGTA (SEQ ID NO: 3056) |
| 56 ORF118_X_129688045_129690722_129712806_129719890_FR | OBD159_2445 | CAGAATAAATGTGTCCCAGATGACG (SEQ ID NO: 3057) |
| 57 ORF119_18_58181079_58183629_58202022_58205094_RF | OBD159_2449 | TCCAGTAGTCTGTGAGCATCTCCAT (SEQ ID NO: 3058) |
| 58 ORF12_10_3728370_3731203_3766614_3768148_RR | OBD159_2453 | CCCTTATTCATTCATCCAGAAAACCA (SEQ ID NO: 3059) |
| 59 ORF12_10_86379474_86383560_86442251_86449187_RF | OBD159_2457 | ATAAATAGGTAAGAAAAGAACAGC (SEQ ID NO: 3060) |
| 60 ORF12_12_10186674_10187896_10218366_10224430_RF | OBD159_2461 | GCTGTGTCTCTCCCAGGTAGGCT (SEQ ID NO: 1684) |
| 61 ORF12_12_82971707_82974166_83009437_83013253_RF | OBD159_2465 | GTTTTGCTGTAGTTTTGCTGAAGTTC (SEQ ID NO: 3062) |
| 62 ORF12_12_83941063_83942894_83954032_83957600_FR | OBD159_2469 | ACATATATTAATATAATAAT (SEQ ID NO: 3063) |
| 63 ORF12_15_91096267_91099737_91157513_91165785_RR | OBD159_2473 | AACACCTTAGCAATACTGTCCCC (SEQ ID NO: 3064) |
| 64 ORF12_16_10002949_10008026_10047306_10049395_RF | OBD159_2477 | CTCAAGTTGTCACAGCATTACCACCT (SEQ ID NO: 438) |
| 65 ORF12_2_79968604_79971437_79981700_79985274_FR | OBD159_2481 | CTATTTCCTCCCCTCACCTTCCACTC (SEQ ID NO: 3066) |
| 66 ORF12_20_10249014_10252827_10332102_10337846_FF | OBD159_2485 | CCCCAGGCAGTCCTATTAGAAAATGT (SEQ ID NO: 3067) |
| 67 ORF12_3_159122585_159126737_159171258_159178334_RR | OBD159_2489 | GCCACCCAAAGACTGTAAGACAAATC (SEQ ID NO: 3068) |
| 68 ORF12_4_125301039_125303568_125344175_125348116_FR | OBD159_2493 | GTGTGTGTGTTCACTATTTCTGACTC (SEQ ID NO: 3069) |
| 69 ORF12_6_41251004_41262260_41306014_41314411_FF | OBD159_2497 | ATGAGAGAAACAAAACCCCACATA (SEQ ID NO: 3070) |
| 70 ORF12_6_5723608_5725733_5763384_5777490_RF | OBD159_2501 | CAAATGGTGGTGGAGCAACGGGT (SEQ ID NO: 3071) |
| 71 ORF12_7_69585104_69587963_69646882_69650626_RF | OBD159_2505 | CATCTCTCACTACCAGGACCAGC (SEQ ID NO: 3072) |
| 72 ORF12_8_93942397_93946048_93985677_93987921_FF | OBD159_2509 | GCCCTCTTAGATTGATGCCAGAAGTA (SEQ ID NO: 1714) |
| 73 ORF12_X_118654955_118657669_118719838_118725132_RR | OBD159_2513 | CAGAAGGGACAACAAACAATCCAGT C (SEQ ID NO: 3074) |
| 74 ORF121_10_62722126_62724612_62762850_62765655_RR | OBD159_2517 | AGTCCAGACCTTGCCACAACCCC (SEQ ID NO: 3075) |
| 75 ORF121_4_114660322_114662941_114712388_114716541_RF | OBD159_2521 | TGCCTCACACAGAGTAGACAATACAT (SEQ ID NO: 3076) |
| 76 ORF123_6_151443530_151449164_151468540_151471174_FR | OBD159_2525 | CGCCTGTAACCCCAGCATTTTGG (SEQ ID NO: 940) |
| 77 ORF124_5_42377041_42385919_42424469_42426692_FF | OBD159_2529 | GGCAAAACAACTTCCCACTGACCTGT (SEQ ID NO: 2024) |
| 78 ORF124_9_125044256_125047827_125094721_125098576_FF | OBD159_2533 | ATCTGAACTGAAATGTATGTAAGTA |

TABLE 4.a7-continued

| Probe | PCR-Primer1_ID | PCR_Primer1 |
|---|---|---|
| | | (SEQ ID NO: 3079) |
| 79ORF124_X_44196000_44203617_44233955_44239522_FF | OBD159_2537 | GGTCGTGAGCCCTTGAGAGTGAC (SEQ ID NO: 3080) |
| 80ORF125_5_141308791_141312972_141341365_141343244_RF | OBD159_2541 | TCCTGGGAAAGCGTTTGCTAACATTA (SEQ ID NO: 3081) |
| 81ORF125_6_28490451_28494501_28536924_28541272_FR | OBD159_2545 | TGTAGATGACTCTCTTTGTCCCCTCA (SEQ ID NO: 3082) |
| 82ORF126_2_68188547_68193452_68260319_68261595_RF | OBD159_2549 | GGGAGAAAATACAACATACAGATGA C (SEQ ID NO: 3083) |
| 83ORF126_5_162107624_162113021_162154110_162157909_RR | OBD159_2553 | CTCTGAGTGTTCACGCCTGGCTC (SEQ ID NO: 3084) |
| 84ORF128_3_63280859_63282281_63322701_63329776_FF | OBD159_2557 | CTATTTTCACATCATCTTGTAAGTT (SEQ ID NO: 3085) |
| 85ORF13_1_203216286_203223882_203265130_203266595_RR | OBD159_2561 | GCGAGCAGCCACTCAGCATTACACTA (SEQ ID NO: 3086) |
| 86ORF13_1_208028237_208035325_208092230_208093532_FR | OBD159_2565 | GCCAGGTATGTCAGGCTCCAGAG (SEQ ID NO: 3087) |
| 87ORF13_12_123039105_123047896_123111911_123114094_FF | OBD159_2569 | GGCTCACGCCTGTAATCCCAGTA (SEQ ID NO: 3088) |
| 88ORF13_12_22550236_22564251_22589587_22591499_RF | OBD159_2573 | GGGCAGAAGATGGAAAAGAACAAGT G (SEQ ID NO: 3089) |
| 89ORF13_13_52983399_52988983_53034265_53036683_FF | OBD159_2577 | TTTTCTTGTTCAATACTGCTACTAC (SEQ ID NO: 3090) |
| 90ORF13_2_11504797_11509096_11532162_11535545_RR | OBD159_2581 | GTGTCTGGCACAAGAAAGGGCTC (SEQ ID NO: 3091) |
| 91ORF13_20_38210518_38212890_38329699_38336059_RR | OBD159_2585 | CCAACAATCTCTCCCCTCACTGC (SEQ ID NO: 3092) |
| 92ORF13_4_187957960_187960546_188016179_188019108_FF | OBD159_2589 | AGAAAGAGGAGGGTGGGATTTTAGG G (SEQ ID NO: 3093) |
| 93ORF13_6_154259046_154260916_154294994_154298490_RF | OBD159_2593 | GTAACGATTTCCCAAGTGGTCCCCAA (SEQ ID NO: 3094) |
| 94ORF13_7_22365643_22368712_22390272_22396878_RF | OBD159_2597 | AGGCTCCTGGGTTCCTATGTTCAAAT (SEQ ID NO: 3053) |
| 95ORF13_8_52230322_52233827_52248401_52253166_RF | OBD159_2601 | GGCATACAAGTAGGATACCAAGCAG A (SEQ ID NO: 3096) |
| 96ORF130_2_77483560_77486991_77514867_77519288_FR | OBD159_2605 | TCCCATTTCCAACTCTTCTGATAAA (SEQ ID NO: 3097) |
| 97ORF131_19_9846242_9849549_9869701_9871067_RF | OBD159_2609 | TGCCTGTAATCCCAGCACTTTGG (SEQ ID NO: 3098) |
| 98ORF132_5_17887397_17895130_17964289_17970189_RR | OBD159_2613 | ACCCAAACCTTCCTTTCTCCACAGAG (SEQ ID NO: 3099) |
| 99ORF133_10_30527367_30529631_30585089_30589121_RR | OBD159_2617 | CACCTGTAATCCCAGCACTTTGG (SEQ ID NO: 3100) |
| 100ORF134_14_68255587_68260022_68325745_68327713_RR | OBD159_2621 | AATCCATCTGCCTCATTTCCCTCCCC (SEQ ID NO: 3101) |
| 101ORF138_17_35287155_35289074_35314277_35315961_FF | OBD159_2625 | CCATCTACTAACCAGAAAGACAGCCC (SEQ ID NO: 3102) |
| 102ORF138_6_151387953_151393542_151443530_151449164_RF | OBD159_2629 | CGCCTGTAACCCCAGCATTTTGG (SEQ ID NO: 940) |
| 103ORF138_6_169185535_169187937_169230654_169232256_FR | OBD159_2633 | ACACATCCACTGATAGGCAACAACTG (SEQ ID NO: 984) |

TABLE 4.a7-continued

| Probe | PCR-Primer1_ID | PCR_Primer1 |
|---|---|---|
| 104ORF139_14_51886119_51892276_51935246_51939339_FF | OBD159_2637 | GTTCCTCTTGCTCCACTTGTCAACAG (SEQ ID NO: 744) |
| 105ORF14_1_110155952_110164041_110184326_110187411_FF | OBD159_2641 | GCATAAAAGAGCCACCTGCCAGC (SEQ ID NO: 3015) |
| 106ORF14_1_76048774_76050727_76086337_76098934_RF | OBD159_2645 | TTACTGGTGTCTTTTATGAACAAA (SEQ ID NO: 3107) |
| 107ORF14_18_23965423_23972468_24001102_24007770_RF | OBD159_2649 | GCCACCTCACCCAGACTATTTTA (SEQ ID NO: 3108) |
| 108ORF14_3_159142637_159144036_159166834_159171258_RF | OBD159_2653 | GCCAACATCTCTCTCTATCTAAATCT (SEQ ID NO: 3109) |
| 109ORF14_3_159142637_159144036_159171258_159178334_RR | OBD159_2657 | TCAGTGGGATGTGAGAAAGCCAATA (SEQ ID NO: 3110) |
| 110ORF14_4_152216416_152218364_152243834_152246201_FR | OBD159_2661 | CCCAGAAAGATGGATGAGTAGAAAA T (SEQ ID NO: 3111) |
| 111ORF14_4_187957960_187960546_188016179_188019108_FF | OBD159_2589 | AGAAAGAGGAGGGTGGGATTTTAGG G (SEQ ID NO: 3093) |
| 112ORF14_8_65603423_65608237_65633322_65635344_FR | OBD159_2665 | GCTGTTTGTTTTGTTTGGGAGAGTAA (SEQ ID NO: 3113) |
| 113ORF14_9_114559604_114561408_114637124_114640336_RF | OBD159_2669 | GAGAAGAGATTGATAAGGTTGTGT (SEQ ID NO: 3114) |
| 114ORF141_9_33273553_33275175_33317596_33319558_FR | OBD159_2673 | CAGTTTACCCTTGAACAGCAAATGC (SEQ ID NO: 3115) |
| 115ORF141_X_40497397_40499087_40520869_40522158_FR | OBD159_2677 | ATGAAGGAAGGGCTCTTGGCTGG (SEQ ID NO: 3116) |
| 116ORF142_X_40497397_40499087_40520869_40522158_FF | OBD159_2681 | ATGAAGGAAGGGCTCTTGGCTGG (SEQ ID NO: 3116) |
| 117ORF143_7_36953187_36955186_36980351_36983506_RR | OBD159_2685 | TGTCAAGAGAGGCACGGTGGCTCAT A (SEQ ID NO: 3118) |
| 118ORF144_14_91001527_91004763_91060989_91062696_RR | OBD159_2689 | CGTGTCCAGGTATTTAGTGGCAGAAA (SEQ ID NO: 3119) |
| 119ORF144_2_167702360_167710563_167770932_167773324_RF | OBD159_2693 | TGAATGAATGAGTCTGTTGGAAAT (SEQ ID NO: 3120) |
| 120ORF144_2_44766242_44769058_44787731_44792832_RF | OBD159_2697 | CCTGGAAGTTTGAGGACAGTTTGGAC (SEQ ID NO: 3121) |

TABLE 4.a8

| | PCR-Primer2_ID | PCR_Primer2 | Marker | GLMNET |
|---|---|---|---|---|
| 1 | OBD159_2231 | TCCTCTGAGACTGCTTTATGGTATCT (SEQ ID NO: 3122) | OBD159_2229_2231 | -0.001099989 |
| 2 | OBD159_2235 | CGTGTAACAGGGCAGCATCTGGG (SEQ ID NO: 3123) | OBD159_2233_2235 | -0.00318743 |
| 3 | OBD159_2239 | GGAAGGTTCTGAGCCGAGAGGAG (SEQ ID NO: 3124) | OBD159_2237_2239 | -0.004676628 |
| 4 | OBD159_2243 | TTGCTCAGGCTGGAATGCGGTGG (SEQ ID NO: 3125) | OBD159_2241_2243 | -0.003238968 |
| 5 | OBD159_2247 | CTTGAACAAATGGATGTGGCTGTGTA (SEQ ID NO: 3126) | OBD159_2245_2247 | -0.003973069 |
| 6 | OBD159_2251 | GAGCAAAAGAAGCCAATGCGAAGGTA (SEQ ID NO: 3127) | OBD159_2249_2251 | -0.001633598 |
| 7 | OBD159_2255 | GTCACTTGTGCTAAATGCCACTTC (SEQ | OBD159_2253_2255 | -0.001854302 |

TABLE 4.a8-continued

| | PCR-Primer2_ID | PCR_Primer2 | Marker | GLMNET |
|---|---|---|---|---|
| | | ID NO: 3128) | | |
| 8 | OBD159_2259 | AAGGATTGCTTGAGCCCAGGAAT (SEQ ID NO: 3129) | OBD159_2257_2259 | -0.002930402 |
| 9 | OBD159_2263 | GGATACTAACTGTGCTACTTTGGAGC (SEQ ID NO: 3130) | OBD159_2261_2263 | -0.001071874 |
| 10 | OBD159_2267 | CAGTAGTCTCCCCTCACCCTGGA (SEQ ID NO: 3131) | OBD159_2265_2267 | -0.001226577 |
| 11 | OBD159_2271 | CATCGTCTTTGGTTTTGATAGTGAAG (SEQ ID NO: 3132) | OBD159_2269_2271 | -0.002857815 |
| 12 | OBD159_2275 | CCCGACATAAATACAGGCAACATCTA (SEQ ID NO: 3133) | OBD159_2273_2275 | -0.002621971 |
| 13 | OBD159_2279 | CCTTTCCCCAAACAAACTTATTCCTT (SEQ ID NO: 3134) | OBD159_2277_2279 | -0.003175304 |
| 14 | OBD159_2283 | CCCAAACTCCAAAGGCAGCGTGC (SEQ ID NO: 3135) | OBD159_2281_2283 | -0.004504979 |
| 15 | OBD159_2287 | GGCAAAAGCAATGAGAATCCAATCAG (SEQ ID NO: 3136) | OBD159_2285_2287 | -0.005705695 |
| 16 | OBD159_2291 | GCGTCCAATCAGAACTTGCGAGC (SEQ ID NO: 1852) | OBD159_2289_2291 | -0.003584401 |
| 17 | OBD159_2295 | GCTTGGGTCTGGAAAGGCAGGAC (SEQ ID NO: 3138) | OBD159_2293_2295 | -0.004126755 |
| 18 | OBD159_2299 | GACTGTGGAAATAAGGATGAAAGAAG (SEQ ID NO: 3139) | OBD159_2297_2299 | -0.001827365 |
| 19 | OBD159_2303 | TCTTGCCTATGTTTTGTTGTATCAT (SEQ ID NO: 3140) | OBD159_2301_2303 | -0.003492146 |
| 20 | OBD159_2307 | GCCTGCCTTGGTGAAACTGACCT (SEQ ID NO: 3141) | OBD159_2305_2307 | -0.00088252 |
| 21 | OBD159_2311 | GTAATACTCTCATTTTAGAAGCAA (SEQ ID NO: 3142) | OBD159_2309_2311 | -6.98E-05 |
| 22 | OBD159_2315 | ACCCACCCACACAGATACCCGTA (SEQ ID NO: 3143) | OBD159_2313_2315 | -0.000581864 |
| 23 | OBD159_2319 | GTTCCATCATAGCAGGATTGGGTCAT (SEQ ID NO: 1026) | OBD159_2317_2319 | -0.002578329 |
| 24 | OBD159_2323 | ATTTTGCTGTGTTTCCCAAGCCTTA (SEQ ID NO: 3145) | OBD159_2321_2323 | -0.000730176 |
| 25 | OBD159_2327 | GGACTCAGACTGCCTGGCTTTGA (SEQ ID NO: 3146) | OBD159_2325_2327 | -0.001214879 |
| 26 | OBD159_2331 | CCTTGGGAAGCCATACTCACCCC (SEQ ID NO: 3147) | OBD159_2329_2331 | -0.002869156 |
| 27 | OBD159_2243 | TTGCTCAGGCTGGAATGCGGTGG (SEQ ID NO: 3125) | OBD159_2241_2243 | -0.003119541 |
| 28 | OBD159_2335 | AAGATACACCAAGCACAAGTCCAAAT (SEQ ID NO: 3149) | OBD159_2333_2335 | -0.002373158 |
| 29 | OBD159_2339 | CTTCAGTTTGGAGCAACACCTTCACG (SEQ ID NO: 3150) | OBD159_2337_2339 | -0.003453509 |
| 30 | OBD159_2343 | TCGTGTGCTACCTGAACTCTGGGACA (SEQ ID NO: 3151) | OBD159_2341_2343 | -0.003945485 |
| 31 | OBD159_2347 | CGTTGGAAGAGATGGCTCCGATG (SEQ ID NO: 3152) | OBD159_2345_2347 | -0.001300019 |
| 32 | OBD159_2351 | GGCACCAAGTAGCCCACAGTATTACC (SEQ ID NO: 3153) | OBD159_2349_2351 | -0.002149682 |
| 33 | OBD159_2355 | GCCTACCAAACAGCCCTGAGAAAGAT | OBD159_2353_2355 | -0.003025162 |

TABLE 4.a8-continued

| PCR-Primer2_ID | PCR_Primer2 | Marker | GLMNET |
|---|---|---|---|
| | (SEQ ID NO: 3154) | | |
| 34 OBD159_2359 | GCCACCACAGTAACCAAAGAAATCT (SEQ ID NO: 3155) | OBD159_2357_2359 | -0.003509337 |
| 35 OBD159_2363 | GGGCATTCATAGTTGCTTTGTTTGTA (SEQ ID NO: 3156) | OBD159_2361_2363 | -0.000950471 |
| 36 OBD159_2367 | CACCTGTAATCCCAGCACTTTGG (SEQ ID NO: 3100) | OBD159_2365_2367 | -0.000179472 |
| 37 OBD159_2371 | GAGACACACAATAAAACAACTGACTC (SEQ ID NO: 3158) | OBD159_2369_2371 | -0.000469302 |
| 38 OBD159_2375 | GTGAAAACAATAATACATACTCTTG (SEQ ID NO: 3159) | OBD159_2373_2375 | -0.00153782 |
| 39 OBD159_2379 | GGACAGGTAACTACGGGTCTCCC (SEQ ID NO: 3160) | OBD159_2377_2379 | -0.003874148 |
| 40 OBD159_2383 | CCCCTTCCTCTCACCCAAAGTTC (SEQ ID NO: 3161) | OBD159_2381_2383 | -0.003036388 |
| 41 OBD159_2387 | TGGGCTGAGGTTCCACAGAGCAG (SEQ ID NO: 3162) | OBD159_2385_2387 | -0.000105726 |
| 42 OBD159_2391 | CTCTAAGCCAAGTGCTAATGAGC (SEQ ID NO: 3163) | OBD159_2389_2391 | -0.001625396 |
| 43 OBD159_2395 | GAAAATAACAGTTCTCAGGAAGGCAT (SEQ ID NO: 3164) | OBD159_2393_2395 | -0.002782935 |
| 44 OBD159_2399 | CTCCACTTCTACCACCACGAGTA (SEQ ID NO: 320) | OBD159_2397_2399 | -0.001994291 |
| 45 OBD159_2403 | ATTTATTCCATTACCTTGGGCACCCC (SEQ ID NO: 3166) | OBD159_2401_2403 | -0.003045347 |
| 46 OBD159_2407 | CTACCCTGCTTTCTGCTGGAGTC (SEQ ID NO: 3167) | OBD159_2405_2407 | -0.003570374 |
| 47 OBD159_2411 | GAGGCTGTTTCCACTACCACATAAAA (SEQ ID NO: 3168) | OBD159_2409_2411 | -0.003053494 |
| 48 OBD159_2415 | AAGATTCCTGCTGGGCTCCATCCTCA (SEQ ID NO: 3169) | OBD159_2413_2415 | -0.00492995 |
| 49 OBD159_2419 | ACATAAAAGGGAGTGCCTGACTAACG (SEQ ID NO: 3170) | OBD159_2417_2419 | -0.000432397 |
| 50 OBD159_2423 | ACCATAAGTGGGTCCCTGTCACG (SEQ ID NO: 3171) | OBD159_2421_2423 | -0.002489477 |
| 51 OBD159_2427 | TCCTTTCCTGAGAGAGTAGGGATA (SEQ ID NO: 3172) | OBD159_2425_2427 | -0.000208789 |
| 52 OBD159_2431 | GGAAAGCAGAAAAGACATCACAAACC (SEQ ID NO: 3173) | OBD159_2429_2431 | -0.00046753 |
| 53 OBD159_2435 | AAACCCCACAATGAGACCTTCTAAAT (SEQ ID NO: 3174) | OBD159_2433_2435 | -0.003120321 |
| 54 OBD159_2439 | GAGCCAGGCACTTGGATTAGCAAAAT (SEQ ID NO: 3175) | OBD159_2437_2439 | -0.002487223 |
| 55 OBD159_2443 | AAATGTGACTCTAAAGTTATCCTGC (SEQ ID NO: 3176) | OBD159_2441_2443 | -0.004687281 |
| 56 OBD159_2447 | AGCCCACACTCCCGTTTTCTGTA (SEQ ID NO: 3177) | OBD159_2445_2447 | -0.001742961 |
| 57 OBD159_2451 | TAACAGAAAAGAAAGAAATAAAGGG (SEQ ID NO: 3178) | OBD159_2449_2451 | -0.002597941 |
| 58 OBD159_2455 | TGGGAAAGAAAGGACCTGTGAGTGTC (SEQ ID NO: 3179) | OBD159_2453_2455 | -0.001962092 |
| 59 OBD159_2459 | TGATGAACGCCTGGGTTTCTTCCA (SEQ | OBD159_2457_2459 | -0.003183439 |

TABLE 4.a8-continued

| PCR-Primer2_ID | PCR_Primer2 | Marker | GLMNET |
|---|---|---|---|
| | ID NO: 3180) | | |
| 60 OBD159_2463 | GCACCATCAGGCTTCTGGGAATG (SEQ ID NO: 1794) | OBD159_2461_2463 | -0.006236142 |
| 61 OBD159_2467 | TATGTCTGCTGCCTCTGTGCTGTC (SEQ ID NO: 3182) | OBD159_2465_2467 | -0.001347005 |
| 62 OBD159_2471 | TTGTATTTAAAAATAGTTCTTT (SEQ ID NO: 3183) | OBD159_2469_2471 | -0.002022685 |
| 63 OBD159_2475 | CTCTAAAACAGGGATGATAATGGCAT (SEQ ID NO: 3184) | OBD159_2473_2475 | -0.002663999 |
| 64 OBD159_2479 | GTTTCTGCTCTTCATCTGGACAGGGC (SEQ ID NO: 3185) | OBD159_2477_2479 | -0.00204052 |
| 65 OBD159_2483 | TGGGCAAGTTTGACTGGACATTTTCT (SEQ ID NO: 2796) | OBD159_2481_2483 | -0.001107302 |
| 66 OBD159_2487 | TAGGGCTGCGTGGTGTTCCATTGTGT (SEQ ID NO: 3187) | OBD159_2485_2487 | -0.00507451 |
| 67 OBD159_2491 | CAGTGTCTCTGACGCACAAATGCCTA (SEQ ID NO: 3188) | OBD159_2489_2491 | 1.50E-05 |
| 68 OBD159_2495 | GCCTCTGGCTGTAATGGATAATCTCC (SEQ ID NO: 3189) | OBD159_2493_2495 | -0.003767198 |
| 69 OBD159_2499 | GAAAGACAGAACATAGAAAACAGAG (SEQ ID NO: 3190) | OBD159_2497_2499 | -0.006879732 |
| 70 OBD159_2503 | CAACAACCTTTTCCTCACACGCAAA (SEQ ID NO: 3191) | OBD159_2501_2503 | -0.005202838 |
| 71 OBD159_2507 | GCATTATTGGGACACATTATTAGGAC (SEQ ID NO: 3192) | OBD159_2505_2507 | -0.001497082 |
| 72 OBD159_2511 | TCCAGAGGAGAGGAAGTGCCACAT (SEQ ID NO: 3193) | OBD159_2509_2511 | -0.003312559 |
| 73 OBD159_2515 | GTCAAGTTTGTGGATTGTGTTGGTCA (SEQ ID NO: 3194) | OBD159_2513_2515 | -0.003444197 |
| 74 OBD159_2519 | GCACGCTCCTGGTGAGATAAGCA (SEQ ID NO: 3195) | OBD159_2517_2519 | -0.000834834 |
| 75 OBD159_2523 | CACCACCAGAAAACCAGAAAGCACCC (SEQ ID NO: 3196) | OBD159_2521_2523 | -0.003566778 |
| 76 OBD159_2527 | GAGGACAACAAGAAGTCGGCTAATA (SEQ ID NO: 3197) | OBD159_2525_2527 | -0.002323473 |
| 77 OBD159_2531 | TGAGCATTCAAATCTCCTAATCACCT (SEQ ID NO: 3198) | OBD159_2529_2531 | -0.0008648 |
| 78 OBD159_2535 | CAGTGTAACCTTTATTTTCCACAAA (SEQ ID NO: 3199) | OBD159_2533_2535 | -0.002098785 |
| 79 OBD159_2539 | CCCTCCTGGTGAGAAGTCATCTG (SEQ ID NO: 3200) | OBD159_2537_2539 | -0.003820154 |
| 80 OBD159_2543 | GACTTGGAATGCCTTGGACTTGCTTA (SEQ ID NO: 3201) | OBD159_2541_2543 | -0.003551293 |
| 81 OBD159_2547 | GCTACTCGGAAACACTCAGAGAGCGA (SEQ ID NO: 3202) | OBD159_2545_2547 | -0.003903276 |
| 82 OBD159_2551 | CTGCCTGAGTTACAACAGAATCCTTT (SEQ ID NO: 3203) | OBD159_2549_2551 | -0.002161088 |
| 83 OBD159_2555 | GACAAGGATTCTGCCCACAAGGC (SEQ ID NO: 3204) | OBD159_2553_2555 | -0.002838208 |
| 84 OBD159_2559 | GCTACCCTATGAACACATTTGCCT (SEQ ID NO: 3205) | OBD159_2557_2559 | -0.005497194 |
| 85 OBD159_2563 | GCAATGGCTGGGAAATAGAAGGCATA | OBD159_2561_2563 | -0.00207864 |

TABLE 4.a8-continued

| PCR-Primer2_ID | PCR_Primer2 | Marker | GLMNET |
|---|---|---|---|
| | (SEQ ID NO: 3206) | | |
| 86 OBD159_2567 | GCCAACTTCTCTTCCAACTCTAAAAT (SEQ ID NO: 3207) | OBD159_2565_2567 | -0.003056695 |
| 87 OBD159_2571 | CATAATGTTTCTGAGGTTCACCAATG (SEQ ID NO: 3208) | OBD159_2569_2571 | -0.003720466 |
| 88 OBD159_2575 | GAAAGGATTAGAGAAGAGCAAGAGTG (SEQ ID NO: 3209) | OBD159_2573_2575 | -0.002178565 |
| 89 OBD159_2579 | TAGTTCTGAATGTGTCGGTGGCTG (SEQ ID NO: 3210) | OBD159_2577_2579 | -0.005320412 |
| 90 OBD159_2583 | ACCTCCCTCGCTCCAAGACCAGA (SEQ ID NO: 3211) | OBD159_2581_2583 | -0.002636746 |
| 91 OBD159_2587 | GCCTGGGTGACAGAGCAAAACTC (SEQ ID NO: 3212) | OBD159_2585_2587 | -0.004348047 |
| 92 OBD159_2591 | GGTGAAACGGACATACGCATAAAGCG (SEQ ID NO: 3213) | OBD159_2589_2591 | -0.002630004 |
| 93 OBD159_2595 | GGATGTGCCTCTTTGGGAGTGAGAAA (SEQ ID NO: 3214) | OBD159_2593_2595 | -0.003958004 |
| 94 OBD159_2599 | TGGGACACCTTCTGCTGCTTTCAGTG (SEQ ID NO: 3215) | OBD159_2597_2599 | -0.000618082 |
| 95 OBD159_2603 | CACTTTCACTCTCAGGTGTGTCCCTA (SEQ ID NO: 3216) | OBD159_2601_2603 | -0.003881393 |
| 96 OBD159_2607 | TGTGCTTGGTTGAACTGAATCATT (SEQ ID NO: 3217) | OBD159_2605_2607 | -0.00219355 |
| 97 OBD159_2611 | GCTCTGCTCTCCCTATCCTTGGC (SEQ ID NO: 3218) | OBD159_2609_2611 | -0.003270066 |
| 98 OBD159_2615 | GCTCTGAGAAAAGGAGTTAGCAAGCA (SEQ ID NO: 3219) | OBD159_2613_2615 | -0.002503083 |
| 99 OBD159_2619 | GTAGTCCCAGCACTTTAGGAGGC (SEQ ID NO: 3220) | OBD159_2617_2619 | -0.002477286 |
| 100 OBD159_2623 | TGCTATGGGTGGTGACAGTTGTGTAT (SEQ ID NO: 3221) | OBD159_2621_2623 | -0.00348659 |
| 101 OBD159_2627 | CTGAAAATCCATTGACTATCTTCTCG (SEQ ID NO: 3222) | OBD159_2625_2627 | -0.004391726 |
| 102 OBD159_2631 | CTGAAAACCTAAAAGGGAACTGAACA (SEQ ID NO: 3223) | OBD159_2629_2631 | -0.002075607 |
| 103 OBD159_2635 | TATGTTACACCCCTTGGCTACCCAGC (SEQ ID NO: 1058) | OBD159_2633_2635 | -0.001633126 |
| 104 OBD159_2639 | GCTGTTTCCTTATCCAAGTCTCAGAT (SEQ ID NO: 3225) | OBD159_2637_2639 | -0.001847004 |
| 105 OBD159_2643 | TACGGAAGATGGAAGTGAGGTGC (SEQ ID NO: 3226) | OBD159_2641_2643 | -0.005178354 |
| 106 OBD159_2647 | GATTTCATTACTATTGTTCTAAGC (SEQ ID NO: 3227) | OBD159_2645_2647 | -0.002421223 |
| 107 OBD159_2651 | CCTCCAAGTTCTCCTTTTCGTTAC (SEQ ID NO: 3228) | OBD159_2649_2651 | -0.003872628 |
| 108 OBD159_2655 | AGCACTTTGGGAGGCTGAGGCAG (SEQ ID NO: 3229) | OBD159_2653_2655 | -0.0022703 |
| 109 OBD159_2659 | CAGTGTCTCTGACGCACAAATGCCTA (SEQ ID NO: 3188) | OBD159_2657_2659 | -0.002830423 |
| 110 OBD159_2663 | GGGAAACTGTGACTCAACCTCAGGAA (SEQ ID NO: 3231) | OBD159_2661_2663 | -0.002003145 |
| 111 OBD159_2591 | GGTGAAACGGACATACGCATAAAGCG | OBD159_2589_2591 | -0.001625766 |

TABLE 4.a8-continued

| | PCR-Primer2_ID | PCR_Primer2 | Marker | GLMNET |
|---|---|---|---|---|
| | | (SEQ ID NO: 3213) | | |
| 112 | OBD159_2667 | GTGAGATAACTGAGGCTCTAAGAACT (SEQ ID NO: 3233) | OBD159_2665_2667 | -0.003832225 |
| 113 | OBD159_2671 | GGGCGACAAAGTGAAACCCTCATT (SEQ ID NO: 3234) | OBD159_2669_2671 | -0.00138426 |
| 114 | OBD159_2675 | GGACTACAGGCGTGAGCCACCAC (SEQ ID NO: 616) | OBD159_2673_2675 | -0.002488264 |
| 115 | OBD159_2679 | CTATCGGAGGGCGGGTCCCAATA (SEQ ID NO: 3236) | OBD159_2677_2679 | -0.001244694 |
| 116 | OBD159_2683 | TGAAGCCTGCCCACAAGGTCAGC (SEQ ID NO: 3237) | OBD159_2681_2683 | -0.00110431 |
| 117 | OBD159_2687 | AACTATCTATCCGTCTGTCTTCTGGC (SEQ ID NO: 3238) | OBD159_2685_2687 | -0.001064378 |
| 118 | OBD159_2691 | TTTCGGCAGTAGCCAATCAGAGACCC (SEQ ID NO: 3239) | OBD159_2689_2691 | -0.003172111 |
| 119 | OBD159_2695 | TACCATCCTCTGCCCTTCAACATA (SEQ ID NO: 3240) | OBD159_2693_2695 | -0.002904958 |
| 120 | OBD159_2699 | GGGCAAATACCATCGCTTTCCCCTA (SEQ ID NO: 3241) | OBD159_2697_2699 | -0.000994852 |

TABLE 4.a9

| | Gene |
|---|---|
| 1 | rs2760501; rs6668586 |
| 2 | FAM160B1; TRUB1; rs968847 |
| 3 | FAM222A; rs763757845 |
| 4 | MTHFD1; ZBTB25; rs34181110; rs2236225; rs2281603 |
| 5 | SCNN1B; SCNN1G; rs137853342 |
| 6 | DPYSL5; rs1371614 |
| 7 | CXADR |
| 8 | CXADR |
| 9 | CXADR |
| 10 | ANKRD55; rs159572; rs6859219; rs10065637; rs71624119; rs10213692; rs7731626; rs28722705 |
| 11 | ANKRD55; rs159572; rs6859219; rs10065637; rs71624119; rs10213692; rs7731626; rs28722705 |
| 12 | ANKRD55; rs1020388; rs6859219; rs10065637; rs71624119; rs10213692; rs7731626; rs28722705; rs159572; rs4700060 |
| 13 | FBXO16; FZD3 |
| 14 | SLC6A17; rs775085213 |
| 15 | KCNC4; SLC6A17; UBL4B; rs775085213; rs375380880 FGFR2; rs755001161; rs148514974; rs10510097; rs4752569; rs3750817; rs7895676; rs10736303; rs11200014; rs2981579; rs1078806; rs2981578; rs35054928; rs2981575; rs1219648; rs1219642; rs2912774; rs2936870; |
| 16 | rs45631563; rs2420946; rs3135724; rs2981582; rs3135718 |
| 17 | ZMYND11; rs606231267; rs1060499626; rs1135401797 |
| 18 | CNTN5; rs1394461 |
| 19 | SV2B; rs886144 |
| 20 | IL4R; rs769790595; rs2107356; rs3785356; rs1805010; rs764099093; rs370524692; rs3024647 |
| 21 | BBX; rs670752 |
| 22 | GTF2E1; rs322458 |
| 23 | GAFA3; PGM2 |
| 24 | ARHGAP36; ENOX2 |
| 25 | EFNB1; rs5937157 |
| 26 | DCD; LACRT; PPP1R1A |
| 27 | MTHFD1; ZBTB25; rs34181110; rs2236225; rs2281603 |
| 28 | C6orf211; CCDC170; RMND1; rs9479072; rs6933660; rs1971256; rs9479055; rs6931664; rs9479068; rs7761420; rs9478217; rs7753676 |
| 29 | CADM2; rs9829032 |
| 30 | ARRDC4 |
| 31 | PDXDC1; rs4003228 |
| 32 | rs12554199 |
| 33 | IBTK; rs10806235 |
| 34 | CTSB; FDFT1; GATA4; NEIL2; rs1466785; rs804279; rs804270; rs148057216; rs8191664; rs7001819; rs2645429; rs2645424; rs6601615; rs8898; rs762727745; rs13332; rs569307763; rs2740594; rs747940576; rs12338 |
| 35 | FRMD4A; rs12220909; rs1218412 |
| 36 | rs6576507; rs547843 |

TABLE 4.a9-continued

| Gene |
| --- |

37 GSPT1; RP11-166B2.1; SNX29; TNFRSF17; rs12922317
38 KDM8; NSMCE1; rs9940555
39 BCAT2; HSD17B14; NUCB1; PLEKHA4; PPP1R15A; TULP2; rs56104184; rs17272694; rs557806;
   rs595982; rs7260579
40 CFAP61; CRNKL1 A20; RIN2; rs1057519885
41 NKX2-2; NKX2-4
42 rs13113999
43 GAFA3; PGM2
44 PLS3; rs201386833
45 AGBL4; SPATA6; rs2803270
46 AGBL4; SPATA6; rs2803270
47 NLGN4X; rs756651509; rs2290488
48 SLC35G3; UNC45B; rs370424081
49 GRIK1; rs455804
50 ELMO1; rs6942726
51 ANKRD55; rs715180
52 RAPGEF5; STEAP1B
53 ZHX2; rs10108684
54 C8orf48
55 ATP6V1G1; C9orf91; rs10513249; rs10817638
56 rs3788853; rs56204867
57 NEDD4L; rs4149601
58 KLF6; rs705464
59 WAPAL; rs7075426; rs731171; rs182554582
60 GABARAPL1; KLRD1; TMEM52B
61 TMTC2; rs7961953
62 rs11116045; rs1545843
63 SV2B; rs886144
64 GRIN2A; rs4107019; rs11644461; rs7192557
65 CTNNA2; rs6752828
66 SNAP25; rs363043; rs363050; rs362584; rs797044873; rs3787283; rs3746544; rs1051312
67 IQCJ; IQCJ-SCHIP1; rs13064773
68 FAT4; rs587777724; rs587777725; rs1039808
69 TREM1; TREML4; rs74851542; rs2234246; rs6910730; rs2234237; rs3789205; rs9471535
70 FARS2; rs397514612; rs775690041
71 AUTS2; rs4718886
72 PDP1; rs7006531
73 DOCK11; IL13RA1
74 rs35306388; rs442309; rs58600253
75 UGT8; rs78557978
76 C6orf211; RMND1; rs370863743
77 GHR; rs6898743
78 PPP6C; SCAI
79 EFHC2; rs7055196
80 PCDHGA1; PCDHGA2; PCDHGA3; TAF7; rs563151485; rs61749035
81 GPX5; GPX6; rs2394103; rs35701070; rs974334; rs13191038; rs406113; rs6456823; rs11757235
82 HZGJ; PPP3R1; rs2120335; rs12052801; rs1822469; rs12465425
83 GABRG2; rs211037; rs397514737; rs121909672; rs1060501889; rs121909674
84 SYNPR; rs13098482
85 CHIT1; rs871799; rs3831317; rs2297950; rs137852607
86 PLXNA2; rs11578508; rs841865; rs752016; rs1327175; rs2478813; rs2498028; rs716461
87 PITPNM2; rs1727294; rs1727307; rs7132277
88 C2CD5; ETNK1
89 OLFM4; rs9568797
90 E2F6; GREB1; rs77294520
91 BPI; KIAA1755; rs6024947; rs6123471; rs6127471; rs4811602; rs877600; rs1341023; rs5743507;
   rs4358188
92 ZFP42; rs6825162; rs6837349; rs4862848
93 CNKSR3; IPCEF1; OPRM1
94 RAPGEF5; STEAP1B
95 ST18; rs2360806
96 LRRTM4; rs61354037
97 OLFM2; PIN1; rs2233682; rs2287838; rs779032127
98 rs140236920
99 LYZL2; MAP3K8
100 RAD51B; rs1570106; rs17105278; rs4902562; rs3784099; rs2208397; rs911263; rs2104047; rs1950897;
    rs11158728; rs927220; rs61985136; rs8017304; rs1956529; rs4902566
101 SLFN11; SLFN5
102 C6orf211; RMND1; ZBTB2; rs115079861; rs886037773; rs886037771; rs397515421; rs1057519299;
    rs773470671; rs144972972; rs771894262; rs606231472; rs886037772; rs370863743
103 THBS2; rs9406328
104 GNG2; rs8015138
105 SLC6A17; rs375380880; rs775085213
106 ST6GALNAC3; rs915404
107 LAMA3; TTC39C
108 IQCJ; IQCJ-SCHIP1; rs13064773
109 IQCJ; IQCJ-SCHIP1; rs13064773
110 FBXW7; rs522743

TABLE 4.a9-continued

| | Gene |
|---|---|
| 111 | ZFP42; rs6825162; rs6837349; rs4862848 |
| 112 | ARMC1; MTFR1 |
| 113 | ATP6V1G1; C9orf91; rs10513249; rs10817638 |
| 114 | BAG1; CHMP5; NFX1 |
| 115 | BCOR; rs2968915 |
| 116 | BCOR; rs2968915 |
| 117 | ELMO1; rs6942726 |
| 118 | C14orf159; RPS6KA5; rs1286150; rs11848357 |
| 119 | rs971257; rs116677506 |
| 120 | CAMKMT; SIX3 |

TABLE 4.b1

| | Probe | GeneLocus |
|---|---|---|
| 121 | ORF144_2_56308065_56316578_56344324_56347884_FF | CCDC85A; rs6747380 |
| 122 | ORF144_X_103107164_103111839_103158530_103163550_FF | BEX4; NXF3 |
| 123 | ORF146_1_229796281_229797522_229849427_229855718_FR | GALNT2; rs4925506 |
| 124 | ORF148_3_40973608_40983324_41025836_41032545_FR | rs62259232; rs35360328 |
| 125 | ORF148_5_56051850_56055700_56069488_56074299_FR | ANKRD55; rs715180 |
| 126 | ORF148_8_22339630_22342765_22370928_22373682_FF | PIWIL2; SLC39A14; rs879253763 |
| 127 | ORF149_4_88278877_88282499_88335985_88339586_FR | PPM1K; rs6819344; rs7661312; rs2869926; rs881561; rs893971; rs17732955; rs9637599; rs4423843; rs4693210; rs958325; rs13128713; rs6845249; rs34813495; rs7655241; rs28406500; rs10024717; rs4693946; rs7678928; rs13151250; rs28375859; rs11931633; rs9995984; rs10018448; rs1440581; rs1440580; rs17013995; rs17789621; rs7676986; rs7677533; rs7660693; rs6841731; rs1899132; rs28789746; rs9998450; rs4693947; rs28884607; rs6532063; rs1595911; rs1595910; rs1808860; rs1808859; rs28504259; rs1545207; rs10022462; rs17014018; rs4693211; rs4693950; rs12512051 |
| 128 | ORF15_1_110155952_110164041_110243262_110248847_FF | KCNC4; SLC6A17; UBL4B; rs775085213; rs375380880 |
| 129 | ORF15_1_186762629_186769807_186806428_186824334_RF | PLA2G4A; rs4140564 |
| 130 | ORF15_1_210312443_210322312_210344738_210348320_RR | HHAT; rs116161686; rs34585985 |
| 131 | ORF15_12_13269291_13270343_13311794_13314398_RF | EMP1; rs1479119 |
| 132 | ORF15_12_13311794_13314398_13342225_13351549_FR | EMP1; rs1479119 |
| 133 | ORF15_2_11479893_11482767_11532162_11535545_RF | E2F6; GREB1; rs77294520 |
| 134 | ORF15_2_5924503_5932342_5965887_5980313_FF | rs10929925; rs16864170 |
| 135 | ORF15_4_37859966_37862832_37914414_37919908_RR | GAFA3; PGM2; PTTG2; TBC1D1; rs17578878; rs35859249 |
| 136 | ORF15_6_134212503_134214388_134270140_134271366_RF | SGK1; rs1743966; rs1009840; rs4896030; rs9493873 |
| 137 | ORF15_6_84752549_84755954_84775145_84786636_FF | TBX18; rs869320679; rs797045022; rs77693245 |
| 138 | ORF15_8_119855069_119857313_119882110_119888009_FR | DEPTOR; DSCC1; TAF2 |
| 139 | ORF15_X_115878688_115881423_115936015_115945579_RF | PLS3; rs201386833 |
| 140 | ORF150_6_89493632_89495030_89546588_89550753_RF | ANKRD6; LYRM2; rs78571182 |
| 141 | ORF150_Y_11007821_11009157_11075743_11080103_FR | rs111611512 |
| 142 | ORF152_2_38148629_38155476_38179203_38180978_FR | ATL2; CYP1B1 |
| 143 | ORF152_5_26952527_26963487_26999889_27004744_FR | CDH9; rs201058683 |
| 144 | ORF152_5_38608515_38611090_38682143_38683313_FF | LIFR; rs185111230 |
| 145 | ORF153_5_26952527_26963487_26999889_27004744_FF | CDH9; rs201058683 |
| 146 | ORF153_8_29144477_29147633_29216944_29221322_FR | KIF13B; rs75609241 |
| 147 | ORF154_12_82572942_82575790_82624217_82631901_FR | METTL25; TMTC2 |
| 148 | ORF155_2_27492451_27495056_27542894_27545242_FF | AC109829.1; FNDC4; GCKR; rs8395; rs2303369; rs704795; rs780090; rs146175795; rs813592; rs1260320; rs149847328; rs2293572; rs2293571; rs1260326; rs3817588; rs4425043; rs6547692; rs780096; rs780095; rs780094; rs780093; rs780092; rs814295; rs11681351; rs704790; rs8179252; rs1260334; rs1260333; rs1313566; rs2950835; rs200826320; rs2911711; rs6753534; rs4665985; rs4665987; rs12473139; rs4665991 |
| 149 | ORF156_16_11987495_11990198_12005204_12009260_FR | SNX29; rs12922317 |
| 150 | ORF156_Y_11007821_11009157_11057559_11075743_FF | rs111611512 |
| 151 | ORF157_1_229796281_229797522_229859020_229862315_FR | GALNT2; rs4925506 |
| 152 | ORF158_16_11987495_11990198_12005204_12009260_FF | SNX29; rs12922317 |
| 153 | ORF158_6_73669509_73673385_73688989_73690148_RF | CD109; SLC17A5 |
| 154 | ORF158_9_33299656_33304064_33317596_33319558_RR | CHMP5; NFX1 |
| 155 | ORF158_X_103336904_103343604_103357970_103363324_RR | TCEAL7; WBP5 |
| 156 | ORF159_10_89863078_89864649_89921840_89926215_FF | KIF20B; rs181778161 |
| 157 | ORF16_6_134270140_134271366_134285274_134289662_FF | SGK1; rs9493873 |

TABLE 4.b1-continued

| | Probe | GeneLocus |
|---|---|---|
| 158 | ORF16_8_21022651_21025530_21074365_21076495_RR | rs7015657; rs500816 |
| 159 | ORF16_9_94791100_94792692_94818790_94822742_RF | C9orf3; rs7026071 |
| 160 | ORF16_X_118719838_118725132_118772495_118775196_RF | IL13RA1; rs3121672; rs2250747 |
| 161 | ORF16_X_134227323_134230233_134251763_134253313_RR | CCDC160; PHF6 |
| 162 | ORF160_10_110775235_110786527_110797638_110800058_RR | RBM20; rs267607001; rs183007628 |
| 163 | ORF160_7_22390272_22396878_22452771_22454987_FR | RAPGEF5; STEAP1B |
| 164 | ORF164_6_37603737_37604889_37629301_37631523_FF | MDGA1; rs9462343 |
| 165 | ORF164_8_97885717_97888667_97935143_97937399_FF | MATN2; rs6987225 |
| 166 | ORF166_11_101998219_102000306_102025025_102027879_FF | C11orf70; KIAA1377 |
| 167 | ORF166_12_54589309_54591607_54623187_54631741_FR | LACRT; PPP1R1A |
| 168 | ORF167_12_46922957_46926200_46952555_46954006_RR | AMIGO2; SLC38A4 |
| 169 | ORF167_15_65512147_65515718_65573794_65596385_RR | DPP8; PTPLAD1; VWA9; rs352479; rs9635366; rs352476; rs2456015; rs2456009; rs12916360; rs11632310; rs12906196; rs7165102 |
| 170 | ORF167_X_11366661_11385597_11459265_11462297_RR | AMELX; ARHGAP6 |
| 171 | ORF168_5_7555641_7557907_7606244_7610178_RR | ADCY2; rs12522444; rs11134242; rs4530734; rs12519539 |
| 172 | ORF168_6_45815741_45822184_45845191_45849862_RR | CLIC5; RUNX2 |
| 173 | ORF169_4_21879694_21883839_21965631_21973272_RR | GPR125; KCNIP4 |
| 174 | ORF169_8_97885717_97888667_97933550_97935143_FR | MATN2; rs6987225 |
| 175 | ORF17_1_110155952_110164041_110184326_110187411_FF | SLC6A17; rs375380880; rs775085213 |
| 176 | ORF17_1_110155952_110164041_110248847_110251734_FR | KCNC4; SLC6A17; UBL4B; rs775085213; rs375380880 |
| 177 | ORF17_12_16574208_16575957_16629200_16637265_RF | LMO3; MGST1; rs10505799 |
| 178 | ORF17_13_53034265_53036683_53047390_53050193_FF | OLFM4; rs12552; rs9568797 |
| 179 | ORF17_15_22830640_22835640_22890866_22893120_FF | CYFIP1; NIPA1; NIPA2; rs4778334; rs371775791; rs576755299 |
| 180 | ORF17_16_11987495_11990198_12005204_12009260_FF | SNX29; rs12922317 |
| 181 | ORF17_2_169092304_169105070_169146919_169154561_FR | DHRS9; LRP2; rs80338753; rs202057289; rs80338754; rs764880181; rs4667594; rs786205122; rs2075252 |
| 182 | ORF17_9_94818790_94822742_94893440_94896165_FF | C9orf3; rs10993397; rs10761362; rs4385527 |
| 183 | ORF17_X_1174946_1177246_1240440_1242375_RF | CRLF2; CSF2RA |
| 184 | ORF17_X_5594024_5600926_5621246_5623679_FR | rs5916200 |
| 185 | ORF170_3_106246431_106249672_106313861_106318469_FR | rs12487066 |
| 186 | ORF170_6_157307294_157314514_157337743_157340036_RF | TMEM242; ZDHHC14 |
| 187 | ORF170_8_113381107_113383608_113436243_113437347_RR | CSMD3; rs189590409 |
| 188 | ORF171_12_26016038_26021057_26034684_26036629_FR | RASSF8; rs1546550 |
| 189 | ORF172_2_129205308_129208404_129231919_129233302_RF | rs1660895; rs13013037 |
| 190 | ORF172_9_33252746_33260644_33317596_33319558_FR | BAG1; CHMP5; NFX1; SPINK4; rs706118; rs3758271 |
| 191 | ORF173_12_96219857_96223649_96237099_96241349_RF | ELK3; rs4762284 |
| 192 | ORF173_8_97885717_97888667_97943674_97946241_FF | MATN2; rs6987225 |
| 193 | ORF176_2_209659511_209662054_209735707_209738646_FF | MAP2; rs9288410; rs146432517 |
| 194 | ORF176_6_61648546_61654260_61698546_61699905_RF | AL356135.1; KHDRBS2; rs140996952; rs76014404 |
| 195 | ORF177_2_21342478_21344227_21387178_21390560_RF | rs2337901; rs11897825 |
| 196 | ORF177_3_78739183_78745105_78757303_78759810_FF | ROBO1; rs919603543 |
| 197 | ORF177_8_97811124_97813316_97885717_97888667_RF | LAPTM4B; MATN2; rs6987225 |
| 198 | ORF179_2_195583610_195589061_195630259_195633750_FR | DNAH7; SLC39A10 |
| 199 | ORF18_1_110155952_110164041_110268937_110272034_FF | KCNC4; SLC6A17; UBL4B; rs775085213; rs375380880 |
| 200 | ORF18_12_83891421_83896037_83954032_83957600_FF | rs11116045; rs1545843 |
| 201 | ORF18_2_11504797_11509096_11532162_11535545_RF | E2F6; GREB1; rs77294520 |
| 202 | ORF18_2_20297935_20303337_20328998_20331608_RR | PUM2; rs111612372 |
| 203 | ORF18_21_17391129_17392895_17437778_17439433_FF | CXADR |
| 204 | ORF18_4_153693586_153700349_153764783_153769098_FF | RNF175; TLR2; rs1898830; rs748086774; rs3804099; rs3804100; rs5743704; rs121917864; rs5743708; rs7656411 |
| 205 | ORF18_6_134212503_134214388_134270140_134271366_RF | SGK1; rs1743966; rs1009840; rs4896030; rs9493873 |
| 206 | ORF18_6_162152986_162154134_162206360_162211749_RF | PARK2; rs566229879; rs765648938; rs137853057; rs778798543; rs747984930 |
| 207 | ORF18_X_37313041_37321250_37333766_37337668_FR | FAM47C; PRRG1 |
| 208 | ORF180_2_56308065_56316578_56390760_56394124_FF | CCDC85A; rs186920977; rs6747380; rs17268785 |
| 209 | ORF183_22_20770086_20774393_20816159_20817209_FR | PI4KA; SERPIND1; rs777006911; rs587777759; rs5907; rs142451096; rs121912420; rs587777760 |
| 210 | ORF183_8_9123942_9126289_9220259_9225462_FR | ERI1; PPP1R3B; rs189798; rs9949; rs3748140; rs7011581; rs6998837; rs6999855; rs378974; rs440932; rs365309; rs3748136 |
| 211 | ORF184_1_211433313_211435632_211464001_211470782_RF | RD3; rs11579557 |
| 212 | ORF184_10_89827266_89829504_89863078_89864649_RF | KIF20B; rs181778161 |
| 213 | ORF184_11_75861382_75864724_75932505_75943225_FF | UVRAG; rs7933235 |
| 214 | ORF184_5_167857386_167858550_167921706_167923030_FR | TENM2; rs9647570 |
| 215 | ORF185_17_16799136_16800747_16881471_16884846_FF | CCDC144A; RP11-219A15.1 |
| 216 | ORF186_6_73688989_73690148_73742434_73750026_FF | CD109; SLC17A5 |
| 217 | ORF187_6_151443530_151449164_151537463_151538576_FF | C6orf211; CCDC170; RMND1; rs370863743; rs6933660; rs1971256; rs9479055; rs6931664 |
| 218 | ORF189_1_48532003_48539768_48603267_48618802_FR | AGBL4; SPATA6; rs2803270 |

TABLE 4.b1-continued

| | Probe | GeneLocus |
|---|---|---|
| 219 | ORF19_1_110141802_110145853_110155952_110164041_RF | SLC6A17; rs775085213 |
| 220 | ORF19_1_223787115_223791224_223834661_223838535_RR | CAPN2; TP53BP2 |
| 221 | ORF19_12_13270343_13274324_13311794_13314398_RF | EMP1; rs1479119 |
| 222 | ORF19_15_22839534_22840551_22879924_22886427_RF | CYFIP1; NIPA2; rs4778334; rs371775791; rs576755299 |
| 223 | ORF19_18_12837148_12839042_12851275_12853060_RF | PTPN2; rs514000; rs11875687; rs657555 |
| 224 | ORF19_2_78763526_78765449_78804372_78809080_FR | REG3G |
| 225 | ORF19_21_17391129_17392895_17434190_17435748_FF | CXADR |
| 226 | ORF19_5_93562856_93565579_93582366_93583770_FF | NR2F1; rs587777277 |
| 227 | ORF19_X_115872740_115875445_115936015_115945579_RF | PLS3; rs201386833 |
| 228 | ORF190_1_48532003_48539768_48603267_48618802_FF | AGBL4; SPATA6; rs2803270 |
| 229 | ORF190_17_36192362_36195269_36216401_36221747_RR | CCL3L3; CCL4L1; TBC1D3B; TBC1D3I |
| 230 | ORF190_4_175635137_175638077_175657671_175665421_RF | GPM6A; rs13144140 |
| 231 | ORF190_8_97885717_97888667_97911504_97913312_FF | LAPTM4B; MATN2 |
| 232 | ORF191_19_46459835_46460902_46479838_46481514_RF | PNMAL1; PNMAL2; PPP5D1 |
| 233 | ORF191_9_28333777_28339631_28374860_28379516_FF | LINGO2; rs7851437 |
| 234 | ORF194_4_15556941_15559956_15665131_15667839_RR | CC2D2A; FBXL5; rs200904521; rs863225178; rs764719093; rs386833748; rs118204053; rs773881370; rs370880399; rs386833749; rs863225173; rs386833750; rs863225169; rs386833751; rs386833752; rs267606709; rs118204051; rs386833753; rs863225170; rs386833754; rs386833755; rs386833756; rs760918829; rs375278294; rs863225171; rs863225172; rs386833757; rs779823379; rs754586025; rs763735590; rs386833758; rs386833759; rs576298659; rs758036385; rs763486732; rs794729225; rs386833760; rs886044295; rs863225176; rs863225168; rs7684446; rs387907058; rs368720062; rs587779732; rs797045437; rs863225179; rs386833762; rs780673487; rs118204052; rs763425007; rs201502401; rs863225174; rs863225175; rs1134634 |
| 235 | ORF195_8_97885717_97888667_97955459_97960176_FR | MATN2; rs6987225 |
| 236 | ORF197_9_33260644_33262136_33317596_33319558_RR | BAG1; CHMP5; NFX1; rs706118; rs3758271 |
| 237 | ORF197_X_101076588_101078760_101106636_101109429_FF | CENPI; TMEM35; TRMT2B |
| 238 | ORF198_13_45792577_45800189_45859224_45860475_RR | SIAH3; rs75061684 |
| 239 | ORF198_14_73418771_73426644_73454993_73457655_RR | HEATR4; NUMB |
| 240 | ORF198_2_164430286_164435469_164495161_164496648_FF | GRB14; rs8192673 |

TABLE 4.b2

| | Probe_Count_Total | Probe_Count_Sig | HyperG_Stats |
|---|---|---|---|
| 121 | 35 | 4; 2 | 0.035189793; 0.255336195 |
| 122 | 17; 17 | 1; 2; 1; 2 | 0.350975055; 0.126473611; 0.350975055; 0.126473611 |
| 123 | 44 | 4; 3 | 0.063857117; 0.169607427 |
| 124 | NA | NA | NA |
| 125 | 72 | 5 | 0.087766242 |
| 126 | 52; 49 | 2; 2; 2; 2 | 0.276304155; 0.273929087; 0.276096976; 0.276409079 |
| 127 | 14 | 1 | 0.337131196 |
| 128 | 49; 68; 56 | 4; 8; 4 | 0.096088025; 0.005458299; 0.123346872 |
| 129 | 19 | 2 | 0.132230242 |
| 130 | 57 | 1 | 0.239596043 |
| 131 | 58 | 1; 3 | 0.234279681; 0.216530763 |
| 132 | 58 | 1; 3 | 0.234279681; 0.216530763 |
| 133 | 48; 40 | 4; 1; 4; 1 | 0.078104352; 0.267628012; 0.050377953; 0.314741981 |
| 134 | NA | NA | NA |
| 135 | 37; 37; 16; 40 | 5; 8; 5; 8; 1; 2; 2; 3 | 0.010942367; 0.000107113; 0.010942367; 0.000107113; 0.343724359; 0.116490918; 0.261899069; 0.150241062 |
| 136 | 108 | 4; 1 | 0.198465555; 0.045253641 |
| 137 | 20 | 4; 5 | 0.005899409; 0.001067155 |
| 138 | 62; 63; 105 | 1; 1; 1 | 0.213548789; 0.208517986; 0.065089658 |
| 139 | 29 | 2; 5 | 0.211050406; 0.005560973 |
| 140 | 23; 23 | 1; 1 | 0.374075448; 0.374075448 |
| 141 | NA | NA | NA |
| 142 | 23; 34 | 4; 3; 4; 3 | 0.009574125; 0.055866229; 0.0324282; 0.117734198 |
| 143 | 30 | 3; 1 | 0.082195447; 0.363021342 |
| 144 | 9 | 1 | 0.255358235 |
| 145 | 30 | 3; 1 | 0.082195447; 0.363021342 |
| 146 | 50 | 1 | 0.255769837 |
| 147 | 9; 27 | 1; 1; 2; 1 | 0.255358235; 0.268692312; 0.197546356; 0.37173223 |
| 148 | 11; 21; 21 | 1; 1; 1 | 0.301350316; 0.37425716; 0.37425716 |
| 149 | 103 | 1; 3 | 0.069157027; 0.178958558 |

TABLE 4.b2-continued

| | Probe_Count_Total | Probe_Count_Sig | HyperG_Stats |
|---|---|---|---|
| 150 | NA | NA | NA |
| 151 | 44 | 4; 3 | 0.063857117; 0.169607427 |
| 152 | 103 | 1; 3 | 0.069157027; 0.178958558 |
| 153 | 34; 34 | 3; 3; 3; 3 | 0.103367502; 0.117734198; 0.103367502; 0.117734198 |
| 154 | 22; 28 | 5; 1; 5; 1 | 0.001196845; 0.375573766; 0.003522831; 0.369266824 |
| 155 | 4; 3 | 1; 1 | 0.14804367; 0.115907508 |
| 156 | 22 | 3 | 0.050708849 |
| 157 | 108 | 4; 1 | 0.198465555; 0.045253641 |
| 158 | NA | NA | NA |
| 159 | 90 | 2 | 0.16104703 |
| 160 | 13 | 2 | 0.076537269 |
| 161 | 26; 38 | 1; 1; 1; 1 | 0.375314357; 0.373699919; 0.340322106; 0.325888812 |
| 162 | 14 | 1 | 0.325643034 |
| 163 | 107; 149 | 3; 3 | 0.188257442; 0.096032365 |
| 164 | 23 | 1 | 0.376115439 |
| 165 | 24 | 6 | 0.000341358 |
| 166 | 13; 27 | 1; 1 | 0.314642613; 0.374553651 |
| 167 | 17; 21 | 2; 2 | 0.126473611; 0.164464127 |
| 168 | 23; 23 | 1; 1; 1; 1 | 0.374075448; 0.376115439; 0.374075448; 0.376115439 |
| 169 | 6; 18; 18 | 1; 1; 1; 1; 1 | 0.203777963; 0.357137933; 0.364965787; 0.357137933; 0.364965787 |
| 170 | 33; 35 | 1; 3; 1; 3 | 0.360592644; 0.112054294; 0.353195365; 0.123360639 |
| 171 | 90 | 3; 3 | 0.219233776; 0.208104371 |
| 172 | 33; 23 | 1; 1 | 0.35096223; 0.376115439 |
| 173 | 14; 21 | 1; 1 | 0.337131196; 0.37425716 |
| 174 | 24 | 6 | 0.000341358 |
| 175 | 68 | 8 | 0.005458299 |
| 176 | 49; 68; 56 | 4; 8; 4 | 0.096088025; 0.005458299; 0.123346872 |
| 177 | 5; 5 | 1; 1 | 0.166301763; 0.166301763 |
| 178 | 26 | 2 | 0.205329626 |
| 179 | 79; 44; 79 | 2; 1; 2 | 0.199035831; 0.291442657; 0.199035831 |
| 180 | 103 | 1; 3 | 0.069157027; 0.178958558 |
| 181 | 49; 70 | 2; 3; 1 | 0.276096976; 0.190339907; 0.151233777 |
| 182 | 90 | 2 | 0.16104703 |
| 183 | 3; 4 | 1; 1 | 0.108032075; 0.138432982 |
| 184 | NA | NA | NA |
| 185 | NA | NA | NA |
| 186 | 98; 77 | 1; 2; 1; 2 | 0.080334308; 0.135364458; 0.14587104; 0.206032338 |
| 187 | 12 | 1; 2 | 0.302214299; 0.076075379 |
| 188 | 48 | 1 | 0.288729231 |
| 189 | NA | NA | NA |
| 190 | 12; 22; 28; 8 | 4; 1; 5; 1; 5; 1; 1 | 0.000827358; 0.314913912; 0.001196845; 0.375573766; 0.003522831; 0.369266824; 0.236185646 |
| 191 | 13 | 2; 3 | 0.076537269; 0.013853987 |
| 192 | 24 | 6 | 0.000341358 |
| 193 | 60 | 5; 7 | 0.05512946; 0.009185497 |
| 194 | 7; 20 | 1; 1 | 0.215038813; 0.366490901 |
| 195 | NA | NA | NA |
| 196 | 29 | 1 | 0.371537436 |
| 197 | 27; 24 | 2; 6 | 0.212429916; 0.000341358 |
| 198 | 61; 81 | 2; 3; 3; 3 | 0.26657373; 0.222001213; 0.227770757; 0.222648484 |
| 199 | 49; 68; 56 | 4; 8; 4 | 0.096088025; 0.005458299; 0.123346872 |
| 200 | NA | NA | NA |
| 201 | 48; 40 | 4; 1; 4; 1 | 0.078104352; 0.267628012; 0.050377953; 0.314741981 |
| 202 | 54 | 5; 6 | 0.040491239; 0.018151611 |
| 203 | 45 | 6; 1 | 0.006017292; 0.285503815 |
| 204 | 22; 30 | 2; 3; 1 | 0.158567173; 0.050708849; 0.363021342 |
| 205 | 108 | 4; 1 | 0.198465555; 0.045253641 |
| 206 | 19 | 1 | 0.362286681 |
| 207 | 16; 4 | 1; 1 | 0.343724359; 0.138432982 |
| 208 | 35 | 4; 2 | 0.035189793; 0.255336195 |
| 209 | 103; 85 | 1; 1 | 0.069157027; 0.117044316 |
| 210 | 62; 136 | 1; 1 | 0.213548789; 0.024430673 |
| 211 | 20 | 1 | 0.366490901 |
| 212 | 22 | 3 | 0.050708849 |
| 213 | 14 | 1; 1 | 0.325643034; 0.337131196 |
| 214 | 43 | 1 | 0.297350686 |
| 215 | 24; 72 | 1; 1 | 0.375122937; 0.166484848 |
| 216 | 34; 34 | 3; 3; 3; 3 | 0.103367502; 0.117734198; 0.103367502; 0.117734198 |
| 217 | 63; 46; 75 | 3; 5; 2; 4; 3; 5 | 0.216848517; 0.076682692; 0.273777277; 0.084172061; 0.228845362; 0.1125292 |
| 218 | 93; 9 | 1; 5; 4 | 0.093070545; 0.156450038; 0.000317369 |
| 219 | 68 | 8 | 0.005458299 |
| 220 | 35; 35 | 1; 1 | 0.353195365; 0.353195365 |
| 221 | 58 | 1; 3 | 0.234279681; 0.216530763 |
| 222 | 79; 79 | 2; 2 | 0.199035831; 0.199035831 |
| 223 | 62 | 1 | 0.213548789 |
| 224 | 3 | 3; 2 | 0; 0.001770535 |
| 225 | 45 | 6; 1 | 0.006017292; 0.285503815 |

TABLE 4.b2-continued

| | Probe_Count_Total | Probe_Count_Sig | HyperG_Stats |
|---|---|---|---|
| 226 | 20 | 1; 2 | 0.366490901; 0.155331399 |
| 227 | 29 | 2; 5 | 0.211050406; 0.005560973 |
| 228 | 93; 9 | 1; 5; 4 | 0.093070545; 0.156450038; 0.000317369 |
| 229 | 68; 70; 76; 36 | 1; 1; 1; 1 | 0.184410962; 0.175291065; 0.149832643; 0.349116343 |
| 230 | 68 | 3; 4 | 0.224345313; 0.163371308 |
| 231 | 27; 24 | 2; 6 | 0.212429916; 0.000341358 |
| 232 | 28; 32; 32 | 3; 4; 3; 4; 3; 4 | 0.071800115; 0.02285211; 0.09275567; 0.033810966; 0.09275567; 0.033810966 |
| 233 | 20 | 6; 4 | 7.69e−05; 0.007618647 |
| 234 | 25; 39 | 1; 1 | 0.375519541; 0.335652067 |
| 235 | 24 | 6 | 0.000341358 |
| 236 | 12; 22; 28 | 4; 1; 5; 1; 5; 1 | 0.000827358; 0.314913912; 0.001196845; 0.375573766; 0.003522831; 0.369266824 |
| 237 | 26; 23; 22 | 1; 1; 1 | 0.375314357; 0.374075448; 0.372324987 |
| 238 | 56 | 3; 2 | 0.199907871; 0.267835203 |
| 239 | 24; 24 | 1; 1 | 0.375945017; 0.375945017 |
| 240 | 11 | 1 | 0.288260522 |

TABLE 4.b3

| | FDR_HyperG | Percent_Sig | logFC | AveExpr |
|---|---|---|---|---|
| 121 | 0.375519541; 0.376115439 | 11.43; 5.71 | 0.49794395 | 0.49794395 |
| 122 | 0.375519541; 0.376115439; 0.375519541; 0.376115439 | 5.88; 11.76; 5.88; 11.76 | 0.574972969 | 0.574972969 |
| 123 | 0.375519541; 0.376115439 | 9.09; 6.82 | 0.676345396 | 0.676345396 |
| 124 | NA | NA | 0.56703579 | 0.56703579 |
| 125 | 0.375519541 | 6.94 | 0.498601338 | 0.498601338 |
| 126 | 0.375519541; 0.376115439; 0.375519541; 0.376115439 | 3.85; 3.85; 4.08; 4.08 | 0.536696835 | 0.536696835 |
| 127 | 0.376115439 | 7.14 | 0.605502672 | 0.605502672 |
| 128 | 0.376115439; 0.217379602; 0.376115439 | 8.16; 11.76; 7.14 | 0.555166048 | 0.555166048 |
| 129 | 0.375519541 | 10.53 | 0.560633088 | 0.560633088 |
| 130 | 0.375519541 | 1.75 | 0.523774327 | 0.523774327 |
| 131 | 0.375519541; 0.376115439 | 1.72; 5.17 | 0.576323107 | 0.576323107 |
| 132 | 0.375519541; 0.376115439 | 1.72; 5.17 | 0.520125142 | 0.520125142 |
| 133 | 0.375519541; 0.376115439; 0.375519541; 0.376115439 | 8.33; 2.08; 10; 2.5 | 0.572693527 | 0.572693527 |
| 134 | NA | NA | 0.575060601 | 0.575060601 |
| 135 | 0.357678624; 0.013656923; 0.357678624; 0.013656923; 0.375519541; 0.376115439; 0.375519541; 0.376115439 | 13.51; 21.62; 13.51; 21.62; 6.25; 12.5; 5; 7.5 | 0.537190811 | 0.537190811 |
| 136 | 0.375519541; 0.376115439 | 3.7; 0.93 | 0.516964113 | 0.516964113 |
| 137 | 0.242080288; 0.077749847 | 20; 25 | 0.584221965 | 0.584221965 |
| 138 | 0.375519541; 0.375519541; 0.375519541 | 1.61; 1.59; 0.95 | 0.492507488 | 0.492507488 |
| 139 | 0.375519541; 0.217379602 | 6.9; 17.24 | 0.551580907 | 0.551580907 |
| 140 | 0.375519541; 0.375519541 | 4.35; 4.35 | 0.554862478 | 0.554862478 |
| 141 | NA | NA | 0.582760434 | 0.582760434 |
| 142 | 0.357661967; 0.376115439; 0.375519541; 0.376115439 | 17.39; 13.04; 11.76; 8.82 | 0.498500581 | 0.498500581 |
| 143 | 0.375519541; 0.376115439 | 10; 3.33 | 0.671204956 | 0.671204956 |
| 144 | 0.375519541 | 11.11 | 0.505781679 | 0.505781679 |
| 145 | 0.375519541; 0.376115439 | 10; 3.33 | 0.627338652 | 0.627338652 |
| 146 | 0.376115439 | 2 | 0.519548665 | 0.519548665 |
| 147 | 0.375519541; 0.376115439; 0.375519541; 0.376115439 | 11.11; 11.11; 7.41; 3.7 | 0.540254875 | 0.540254875 |
| 148 | 0.376115439; 0.376115439; 0.376115439 | 9.09; 4.76; 4.76 | 0.651040571 | 0.651040571 |
| 149 | 0.375519541; 0.376115439 | 0.97; 2.91 | 0.558410651 | 0.558410651 |
| 150 | NA | NA | 0.586811279 | 0.586811279 |
| 151 | 0.375519541; 0.376115439 | 9.09; 6.82 | 0.88524663 | 0.88524663 |
| 152 | 0.375519541; 0.376115439 | 0.97; 2.91 | 0.569679093 | 0.569679093 |
| 153 | 0.375519541; 0.376115439; 0.375519541; 0.376115439 | 8.82; 8.82; 8.82; 8.82 | 0.488859424 | 0.488859424 |
| 154 | 0.069549998; 0.376115439; 0.184244052; 0.376115439 | 22.73; 4.55; 17.86; 3.57 | 0.508181318 | 0.508181318 |
| 155 | 0.376115439; 0.376115439 | 25; 33.33 | 0.506933415 | 0.506933415 |
| 156 | 0.376115439 | 13.64 | 0.620446381 | 0.620446381 |
| 157 | 0.375519541; 0.376115439 | 3.7; 0.93 | 0.500746342 | 0.500746342 |
| 158 | NA | NA | 0.498126377 | 0.498126377 |
| 159 | 0.376115439 | 2.22 | 0.670441293 | 0.670441293 |
| 160 | 0.375519541 | 15.38 | 0.523587776 | 0.523587776 |
| 161 | 0.375519541; 0.376115439; 0.375519541; 0.376115439 | 3.85; 3.85; 2.63; 2.63 | 0.536833953 | 0.536833953 |
| 162 | 0.375519541 | 7.14 | 0.573209773 | 0.573209773 |
| 163 | 0.375519541; 0.375519541 | 2.8; 2.01 | 0.791377185 | 0.791377185 |

TABLE 4.b3-continued

| | FDR_HyperG | Percent_Sig | logFC | AveExpr |
|---|---|---|---|---|
| 164 | 0.376115439 | 4.35 | 0.520612115 | 0.520612115 |
| 165 | 0.029015407 | 25 | 0.535238893 | 0.535238893 |
| 166 | 0.375519541; 0.375519541 | 7.69; 3.7 | 0.513829718 | 0.513829718 |
| 167 | 0.376115439; 0.376115439 | 11.76; 9.52 | 0.654409102 | 0.654409102 |
| 168 | 0.375519541; 0.376115439; 0.375519541; 0.376115439 | 4.35; 4.35; 4.35; 4.35 | 0.496111451 | 0.496111451 |
| 169 | 0.376115439; 0.375519541; 0.376115439; 0.375519541; 0.376115439 | 16.67; 5.56; 5.56; 5.56; 5.56 | 0.531846872 | 0.531846872 |
| 170 | 0.375519541; 0.376115439; 0.375519541; 0.376115439 | 3.03; 9.09; 2.86; 8.57 | 0.530818677 | 0.530818677 |
| 171 | 0.375519541; 0.376115439 | 3.33; 3.33 | 0.55374233 | 0.55374233 |
| 172 | 0.376115439; 0.376115439 | 3.03; 4.35 | 0.542210968 | 0.542210968 |
| 173 | 0.376115439; 0.376115439 | 7.14; 4.76 | 0.551966491 | 0.551966491 |
| 174 | 0.029015407 | 25 | 0.53664704 | 0.53664704 |
| 175 | 0.217379602 | 11.76 | 0.537986332 | 0.537986332 |
| 176 | 0.376115439; 0.217379602; 0.376115439 | 8.16; 11.76; 7.14 | 0.510248727 | 0.510248727 |
| 177 | 0.375519541; 0.375519541 | 20; 20 | 0.502927603 | 0.502927603 |
| 178 | 0.376115439 | 7.69 | 0.517900142 | 0.517900142 |
| 179 | 0.376115439; 0.376115439; 0.376115439 | 2.53; 2.27; 2.53 | 0.517060093 | 0.517060093 |
| 180 | 0.375519541; 0.376115439 | 0.97; 2.91 | 0.550973282 | 0.550973282 |
| 181 | 0.375519541; 0.376115439; 0.376115439 | 4.08; 6.12; 1.43 | 0.508324657 | 0.508324657 |
| 182 | 0.376115439 | 2.22 | 0.62763647 | 0.62763647 |
| 183 | 0.375519541; 0.375519541 | 33.33; 25 | 0.547714198 | 0.547714198 |
| 184 | NA | NA | 0.529013394 | 0.529013394 |
| 185 | NA | NA | 0.52084086 | 0.52084086 |
| 186 | 0.375519541; 0.376115439; 0.375519541; 0.376115439 | 1.02; 2.04; 1.3; 2.6 | 0.608493429 | 0.608493429 |
| 187 | 0.375519541; 0.376115439 | 8.33; 16.67 | 0.570976711 | 0.570976711 |
| 188 | 0.375519541 | 2.08 | 0.499117065 | 0.499117065 |
| 189 | NA | NA | 0.505254484 | 0.505254484 |
| 190 | 0.069549998; 0.376115439; 0.069549998; 0.376115439; 0.184244052; 0.376115439; 0.375519541 | 33.33; 8.33; 22.73; 4.55; 17.86; 3.57; 12.5 | 0.683547978 | 0.683547978 |
| 191 | 0.375519541; 0.376115439 | 15.38; 23.08 | 0.627554365 | 0.627554365 |
| 192 | 0.029015407 | 25 | 0.539962942 | 0.539962942 |
| 193 | 0.375519541; 0.275564898 | 8.33; 11.67 | 0.577920661 | 0.577920661 |
| 194 | 0.375519541; 0.375519541 | 14.29; 5 | 0.494528263 | 0.494528263 |
| 195 | NA | NA | 0.552975716 | 0.552975716 |
| 196 | 0.375519541 | 3.45 | 0.518597304 | 0.518597304 |
| 197 | 0.376115439; 0.029015407 | 7.41; 25 | 0.535869894 | 0.535869894 |
| 198 | 0.375519541; 0.376115439; 0.375519541; 0.376115439 | 3.28; 4.92; 3.7; 3.7 | 0.547664462 | 0.547664462 |
| 199 | 0.376115439; 0.217379602; 0.376115439 | 8.16; 11.76; 7.14 | 0.542692413 | 0.542692413 |
| 200 | NA | NA | 0.550722797 | 0.550722797 |
| 201 | 0.375519541; 0.376115439; 0.375519541; 0.376115439 | 8.33; 2.08; 10; 2.5 | 0.636516912 | 0.636516912 |
| 202 | 0.375519541; 0.376115439 | 9.26; 11.11 | 0.565299033 | 0.565299033 |
| 203 | 0.242080288; 0.376115439 | 13.33; 2.22 | 0.500923703 | 0.500923703 |
| 204 | 0.375519541; 0.376115439; 0.376115439 | 9.09; 13.64; 3.33 | 0.526105484 | 0.526105484 |
| 205 | 0.375519541; 0.376115439 | 3.7; 0.93 | 0.754692971 | 0.754692971 |
| 206 | 0.375519541 | 5.26 | 0.511869617 | 0.511869617 |
| 207 | 0.375519541; 0.375519541 | 6.25; 25 | 0.506803758 | 0.506803758 |
| 208 | 0.375519541; 0.376115439 | 11.43; 5.71 | 0.517919559 | 0.517919559 |
| 209 | 0.375519541; 0.375519541 | 0.97; 1.18 | 0.508803409 | 0.508803409 |
| 210 | 0.375519541; 0.375519541 | 1.61; 0.74 | 0.50748688 | 0.50748688 |
| 211 | 0.375519541 | 5 | 0.492873937 | 0.492873937 |
| 212 | 0.376115439 | 13.64 | 0.636576789 | 0.636576789 |
| 213 | 0.375519541; 0.376115439 | 7.14; 7.14 | 0.525893371 | 0.525893371 |
| 214 | 0.376115439 | 2.33 | 0.669996472 | 0.669996472 |
| 215 | 0.375519541; 0.375519541 | 4.17; 1.39 | 0.514514317 | 0.514514317 |
| 216 | 0.375519541; 0.376115439; 0.375519541; 0.376115439 | 8.82; 8.82; 8.82; 8.82 | 0.72143182 | 0.72143182 |
| 217 | 0.375519541; 0.376115439; 0.375519541; 0.376115439; 0.375519541; 0.376115439 | 4.76; 7.94; 4.35; 8.7; 4; 6.67 | 0.533097441 | 0.533097441 |
| 218 | 0.375519541; 0.376115439; 0.029015407 | 1.08; 5.38; 44.44 | 0.546782401 | 0.546782401 |
| 219 | 0.217379602 | 11.76 | 0.565839306 | 0.565839306 |
| 220 | 0.375519541; 0.375519541 | 2.86; 2.86 | 0.525833608 | 0.525833608 |
| 221 | 0.375519541; 0.376115439 | 1.72; 5.17 | 0.557894771 | 0.557894771 |
| 222 | 0.376115439; 0.376115439 | 2.53; 2.53 | 0.602870802 | 0.602870802 |
| 223 | 0.375519541 | 1.61 | 0.548038418 | 0.548038418 |
| 224 | 0; 0.082088441 | 100; 100 | 0.597004784 | 0.597004784 |
| 225 | 0.242080288; 0.376115439 | 13.33; 2.22 | 0.553333021 | 0.553333021 |
| 226 | 0.375519541; 0.376115439 | 5; 10 | 0.551890023 | 0.551890023 |
| 227 | 0.375519541; 0.217379602 | 6.9; 17.24 | 0.560179256 | 0.560179256 |
| 228 | 0.375519541; 0.376115439; 0.029015407 | 1.08; 5.38; 44.44 | 0.602757851 | 0.602757851 |
| 229 | 0.375519541; 0.375519541; 0.375519541; 0.375519541 | 1.47; 1.43; 1.32; 2.78 | 0.506882645 | 0.506882645 |
| 230 | 0.375519541; 0.376115439 | 4.41; 5.88 | 0.638332442 | 0.638332442 |

TABLE 4.b3-continued

| | FDR_HyperG | Percent_Sig | logFC | AveExpr |
|---|---|---|---|---|
| 231 | 0.376115439; 0.029015407 | 7.41; 25 | 0.554106903 | 0.554106903 |
| 232 | 0.375519541; 0.376115439; 0.375519541; 0.376115439; 0.375519541; 0.376115439 | 10.71; 14.29; 9.38; 12.5; 9.38; 12.5 | 0.509029721 | 0.509029721 |
| 233 | 0.008046243; 0.242844385 | 30; 20 | 0.570068001 | 0.570068001 |
| 234 | 0.375519541; 0.375519541 | 4; 2.56 | 0.507418689 | 0.507418689 |
| 235 | 0.029015407 | 25 | 0.5198147 | 0.5198147 |
| 236 | 0.069549998; 0.376115439; 0.069549998; 0.376115439; 0.184244052; 0.376115439 | 33.33; 8.33; 22.73; 4.55; 17.86; 3.57 | 0.665092008 | 0.665092008 |
| 237 | 0.375519541; 0.375519541; 0.375519541 | 3.85; 4.35; 4.55 | 0.517555894 | 0.517555894 |
| 238 | 0.375519541; 0.376115439 | 5.36; 3.57 | 0.498659086 | 0.498659086 |
| 239 | 0.376115439; 0.376115439 | 4.17; 4.17 | 0.569145704 | 0.569145704 |
| 240 | 0.375519541 | 9.09 | 0.510819621 | 0.510819621 |

TABLE 4.b4

| | t | P.Value | adj.P.Val | B | FC | FC_1 | LS |
|---|---|---|---|---|---|---|---|
| 121 | 12.85571368 | 0.0000000227 | 0.00000441 | 9.818282467 | 1.412199538 | 1.412199538 | 1 |
| 122 | 8.231552521 | 0.00000291 | 0.000144892 | 4.97091064 | 1.489649552 | 1.489649552 | 1 |
| 123 | 2.845380122 | 0.014816813 | 0.049671625 | −3.722332957 | 1.598086385 | 1.598086385 | 1 |
| 124 | 10.12548163 | 0.000000317 | 0.0000196 | 7.175876122 | 1.481476549 | 1.481476549 | 1 |
| 125 | 3.978613043 | 0.001836205 | 0.006999235 | −1.732533005 | 1.412843177 | 1.412843177 | 1 |
| 126 | 8.721949362 | 0.00000155 | 0.0000528 | 5.554231972 | 1.45064734 | 1.45064734 | 1 |
| 127 | 9.501845473 | 0.000000647 | 0.0000568 | 6.493327999 | 1.521508794 | 1.521508794 | 1 |
| 128 | 16.26352226 | 0.000000000165 | 0.00000233 | 12.28695 | 1.469337738 | 1.469337738 | 1 |
| 129 | 6.754609442 | 0.0000205 | 0.000279727 | 2.897404578 | 1.474916303 | 1.474916303 | 1 |
| 130 | 11.7906202 | 0.0000000597 | 0.00000731 | 8.858213504 | 1.437711621 | 1.437711621 | 1 |
| 131 | 4.33868702 | 0.000975622 | 0.007074083 | −0.991794894 | 1.491044285 | 1.491044285 | 1 |
| 132 | 3.972131381 | 0.001871133 | 0.011234207 | −1.654031412 | 1.434079637 | 1.434079637 | 1 |
| 133 | 3.955204751 | 0.00191528 | 0.007229568 | −1.775415751 | 1.48729778 | 1.48729778 | 1 |
| 134 | 9.342186066 | 0.000000775 | 0.0000634 | 6.311747093 | 1.489740039 | 1.489740039 | 1 |
| 135 | 9.484575564 | 0.00000066 | 0.0000575 | 6.473815582 | 1.451144124 | 1.451144124 | 1 |
| 136 | 7.241225979 | 0.0000104 | 0.000178041 | 3.6008145 | 1.430940925 | 1.430940925 | 1 |
| 137 | 11.28626762 | 0.0000001 | 0.0000185 | 8.353950742 | 1.499230247 | 1.499230247 | 1 |
| 138 | 3.861809638 | 0.002267394 | 0.008226288 | −1.946872616 | 1.406888006 | 1.406888006 | 1 |
| 139 | 3.169858859 | 0.008120403 | 0.031375457 | −3.128902502 | 1.465690922 | 1.465690922 | 1 |
| 140 | 7.521461416 | 0.00000709 | 0.000138258 | 3.991565908 | 1.469028595 | 1.469028595 | 1 |
| 141 | 9.212944028 | 0.000000898 | 0.0000693 | 6.162784193 | 1.497712211 | 1.497712211 | 1 |
| 142 | 7.712692775 | 0.00000551 | 0.000117803 | 4.252371373 | 1.412744509 | 1.412744509 | 1 |
| 143 | 3.461607356 | 0.004713239 | 0.014405738 | −2.68619229 | 1.592402406 | 1.592402406 | 1 |
| 144 | 15.36143873 | 0.000000000302 | 0.00000157 | 11.78564206 | 1.419892472 | 1.419892472 | 1 |
| 145 | 3.734296254 | 0.002858728 | 0.009823574 | −2.181777444 | 1.544712822 | 1.544712822 | 1 |
| 146 | 5.979075369 | 0.0000656 | 0.001100184 | 1.775797396 | 1.433506717 | 1.433506717 | 1 |
| 147 | 9.091470009 | 0.000001 | 0.0000402 | 6.001316146 | 1.454229407 | 1.454229407 | 1 |
| 148 | 8.049768551 | 0.00000365 | 0.000167633 | 4.73774119 | 1.570300396 | 1.570300396 | 1 |
| 149 | 10.79174104 | 0.000000164 | 0.000025 | 7.867535813 | 1.472645979 | 1.472645979 | 1 |
| 150 | 8.606133556 | 0.00000183 | 0.000108855 | 5.438869381 | 1.501923445 | 1.501923445 | 1 |
| 151 | 2.961593771 | 0.011946063 | 0.042253055 | −3.510770243 | 1.847080354 | 1.847080354 | 1 |
| 152 | 11.85164459 | 0.0000000586 | 0.0000136 | 8.885130644 | 1.484193396 | 1.484193396 | 1 |
| 153 | 11.41630184 | 0.0000000854 | 0.00000896 | 8.500433368 | 1.403334979 | 1.403334979 | 1 |
| 154 | 7.249747156 | 0.0000102 | 0.000176539 | 3.61284838 | 1.422256149 | 1.422256149 | 1 |
| 155 | 6.045822089 | 0.0000593 | 0.00102514 | 1.880551388 | 1.421026456 | 1.421026456 | 1 |
| 156 | 9.687346929 | 0.00000527 | 0.0000503 | 6.700976262 | 1.537350776 | 1.537350776 | 1 |
| 157 | 4.942191323 | 0.000342375 | 0.002016294 | −0.012425986 | 1.41494536 | 1.41494536 | 1 |
| 158 | 13.98911851 | 0.00000000877 | 0.00000269 | 10.75468457 | 1.41237812 | 1.41237812 | 1 |
| 159 | 11.09507367 | 0.000000121 | 0.0000207 | 8.168379643 | 1.591559721 | 1.591559721 | 1 |
| 160 | 9.309736917 | 0.000000781 | 0.0000343 | 6.258410544 | 1.437525727 | 1.437525727 | 1 |
| 161 | 8.396894602 | 0.00000231 | 0.0000676 | 5.148192363 | 1.45078522 | 1.45078522 | 1 |
| 162 | 12.67393184 | 0.0000000267 | 0.00000483 | 9.660199745 | 1.487830083 | 1.487830083 | 1 |
| 163 | 2.813298857 | 0.015673542 | 0.0371907 | −3.880370031 | 1.730725811 | 1.730725811 | 1 |
| 164 | 6.035610068 | 0.0000602 | 0.001037168 | 1.864565691 | 1.434563784 | 1.434563784 | 1 |
| 165 | 4.940370511 | 0.000347282 | 0.003485151 | 0.064476687 | 1.449182102 | 1.449182102 | 1 |
| 166 | 12.31154813 | 0.0000000369 | 0.00000569 | 9.338114755 | 1.427835442 | 1.427835442 | 1 |
| 167 | 5.995551995 | 0.000064 | 0.001082323 | 1.801715498 | 1.573971155 | 1.573971155 | 1 |
| 168 | 16.14993211 | 0.00000000170 | 0.00000121 | 12.33278112 | 1.410406913 | 1.410406913 | 1 |
| 169 | 13.01163173 | 0.0000000207 | 0.00000806 | 9.898762683 | 1.445778831 | 1.445778831 | 1 |
| 170 | 5.713793654 | 0.000099 | 0.001452511 | 1.35315809 | 1.444748805 | 1.444748805 | 1 |
| 171 | 7.78538955 | 0.00000513 | 0.000207293 | 4.391330899 | 1.467888443 | 1.467888443 | 1 |
| 172 | 3.034614526 | 0.010433466 | 0.038044461 | −3.377210184 | 1.456202476 | 1.456202476 | 1 |
| 173 | 7.974342948 | 0.00000402 | 0.000177478 | 4.639802692 | 1.466082705 | 1.466082705 | 1 |
| 174 | 4.877852747 | 0.000385763 | 0.003742478 | −0.043225865 | 1.450597271 | 1.450597271 | 1 |
| 175 | 15.8014145 | 0.00000000230 | 0.00000269 | 11.98274113 | 1.451944524 | 1.451944524 | 1 |
| 176 | 9.6824494 | 0.000000529 | 0.0000505 | 6.695539289 | 1.424295729 | 1.424295729 | 1 |
| 177 | 8.982291074 | 0.00000114 | 0.0000434 | 5.8707888 | 1.417086282 | 1.417086282 | 1 |
| 178 | 13.00991009 | 0.0000000207 | 0.00000806 | 9.897329162 | 1.431869629 | 1.431869629 | 1 |

TABLE 4.b4-continued

| | t | P.Value | adj.P.Val | B | FC | FC_1 | LS |
|---|---|---|---|---|---|---|---|
| 179 | 3.771629684 | 0.002687951 | 0.014413366 | −2.020655743 | 1.431036126 | 1.431036126 | 1 |
| 180 | 11.91225488 | 0.0000000554 | 0.0000134 | 8.940567065 | 1.465073741 | 1.465073741 | 1 |
| 181 | 6.970521521 | 0.0000154 | 0.000417149 | 3.266777256 | 1.422397464 | 1.422397464 | 1 |
| 182 | 7.906910766 | 0.00000438 | 0.000187785 | 4.551644468 | 1.545031734 | 1.545031734 | 1 |
| 183 | 13.91369902 | 0.00000000932 | 0.00000277 | 10.69488844 | 1.46176784 | 1.46176784 | 1 |
| 184 | 10.57073217 | 0.000000199 | 0.0000149 | 7.649470401 | 1.442942083 | 1.442942083 | 1 |
| 185 | 12.15610883 | 0.0000000442 | 0.000012 | 9.160755692 | 1.434791257 | 1.434791257 | 1 |
| 186 | 7.830227053 | 0.00000484 | 0.000199643 | 4.450698508 | 1.524666206 | 1.524666206 | 1 |
| 187 | 13.24846035 | 0.0000000169 | 0.0000073 | 10.09405586 | 1.48552894 | 1.48552894 | 1 |
| 188 | 10.51366843 | 0.000000211 | 0.0000154 | 7.589793821 | 1.413348323 | 1.413348323 | 1 |
| 189 | 9.142634001 | 0.000000973 | 0.0000728 | 6.080992301 | 1.419373704 | 1.419373704 | 1 |
| 190 | 6.674812554 | 0.0000229 | 0.000301937 | 2.778974192 | 1.6060847 | 1.6060847 | 1 |
| 191 | 9.469337194 | 0.000000671 | 0.0000579 | 6.456572713 | 1.544943807 | 1.544943807 | 1 |
| 192 | 4.908630686 | 0.000366289 | 0.00361381 | 0.009859863 | 1.45393517 | 1.45393517 | 1 |
| 193 | 7.319368215 | 0.00000951 | 0.000306736 | 3.758961631 | 1.492696293 | 1.492696293 | 1 |
| 194 | 3.570632974 | 0.003856746 | 0.012364677 | −2.484294523 | 1.408860006 | 1.408860006 | 1 |
| 195 | 12.09931975 | 0.0000000466 | 0.0000122 | 9.1098815 | 1.467108649 | 1.467108649 | 1 |
| 196 | 12.25910518 | 0.0000000387 | 0.00000581 | 9.290719363 | 1.432561727 | 1.432561727 | 1 |
| 197 | 4.929323234 | 0.000353777 | 0.003529178 | 0.045489709 | 1.449816079 | 1.449816079 | 1 |
| 198 | 7.098710211 | 0.0000129 | 0.000370959 | 3.449548611 | 1.461717447 | 1.461717447 | 1 |
| 199 | 12.87639745 | 0.0000000233 | 0.00000866 | 9.785543484 | 1.456688511 | 1.456688511 | 1 |
| 200 | 25.56871967 | 0.00000000000802 | 0.00000021 | 17.07032839 | 1.464819394 | 1.464819394 | 1 |
| 201 | 5.282358199 | 0.000194846 | 0.001333347 | 0.568489571 | 1.554571435 | 1.554571435 | 1 |
| 202 | 7.909033584 | 0.00000437 | 0.000187525 | 4.554428423 | 1.47969418 | 1.47969418 | 1 |
| 203 | 7.949377976 | 0.00000405 | 0.0000965 | 4.56875885 | 1.415119319 | 1.415119319 | 1 |
| 204 | 12.26815 | 0.00000004 | 0.0000113 | 9.260418448 | 1.440036604 | 1.440036604 | 1 |
| 205 | 10.34036867 | 0.000000253 | 0.0000172 | 7.40673757 | 1.687272474 | 1.687272474 | 1 |
| 206 | 10.15869423 | 0.000000306 | 0.0000192 | 7.211842252 | 1.425896847 | 1.425896847 | 1 |
| 207 | 8.882389933 | 0.00000128 | 0.0000466 | 5.750208152 | 1.420898753 | 1.420898753 | 1 |
| 208 | 13.80179636 | 0.0000000102 | 0.00000289 | 10.60552951 | 1.4318889 | 1.4318889 | 1 |
| 209 | 5.751647537 | 0.0000919 | 0.000779941 | 1.343982865 | 1.422869558 | 1.422869558 | 1 |
| 210 | 5.136592019 | 0.000247594 | 0.001589372 | 0.321442156 | 1.421571713 | 1.421571713 | 1 |
| 211 | 8.109694021 | 0.0000033 | 0.0000843 | 4.779115391 | 1.407245405 | 1.407245405 | 1 |
| 212 | 10.45402001 | 0.000000232 | 0.0000309 | 7.52298061 | 1.554635956 | 1.554635956 | 1 |
| 213 | 6.629180754 | 0.0000245 | 0.000314786 | 2.710853914 | 1.439824897 | 1.439824897 | 1 |
| 214 | 4.288460006 | 0.001065705 | 0.007539514 | −1.081806761 | 1.591069077 | 1.591069077 | 1 |
| 215 | 13.09997614 | 0.0000000184 | 0.00000396 | 10.02714542 | 1.42851315 | 1.42851315 | 1 |
| 216 | 11.17748674 | 0.000000112 | 0.0000198 | 8.248747382 | 1.648817612 | 1.648817612 | 1 |
| 217 | 14.87281024 | 0.00000000458 | 0.00000374 | 11.33855454 | 1.447032617 | 1.447032617 | 1 |
| 218 | 6.575892876 | 0.000027 | 0.000606493 | 2.689903304 | 1.460824029 | 1.460824029 | 1 |
| 219 | 13.60527413 | 0.0000000125 | 0.00000619 | 10.38131994 | 1.480248412 | 1.480248412 | 1 |
| 220 | 20.55612849 | 0.000000000104 | 0.00000039 | 14.90007122 | 1.439765255 | 1.439765255 | 1 |
| 221 | 3.828560252 | 0.002424285 | 0.013569984 | −1.916307699 | 1.472119483 | 1.472119483 | 1 |
| 222 | 10.97761516 | 0.000000136 | 0.0000222 | 8.052832823 | 1.518735676 | 1.518735676 | 1 |
| 223 | 7.223168655 | 0.0000106 | 0.000181098 | 3.575281525 | 1.462096382 | 1.462096382 | 1 |
| 224 | 8.856700446 | 0.00000132 | 0.0000475 | 5.719022371 | 1.512573013 | 1.512573013 | 1 |
| 225 | 8.136727525 | 0.00000319 | 0.0000826 | 4.814277911 | 1.467472046 | 1.467472046 | 1 |
| 226 | 8.327264523 | 0.00000258 | 0.000134588 | 5.092067144 | 1.466004999 | 1.466004999 | 1 |
| 227 | 3.227731699 | 0.007295404 | 0.029311202 | −3.022381083 | 1.474452408 | 1.474452408 | 1 |
| 228 | 6.696966991 | 0.0000226 | 0.000540491 | 2.869194342 | 1.518616776 | 1.518616776 | 1 |
| 229 | 3.436982889 | 0.004932147 | 0.014935202 | −2.731810563 | 1.42097645 | 1.42097645 | 1 |
| 230 | 8.62747067 | 0.00000179 | 0.000106929 | 5.465029698 | 1.556528984 | 1.556528984 | 1 |
| 231 | 5.056118713 | 0.000286287 | 0.003040948 | 0.262536206 | 1.468259429 | 1.468259429 | 1 |
| 232 | 5.957365232 | 0.0000678 | 0.001122961 | 1.74158754 | 1.423092778 | 1.423092778 | 1 |
| 233 | 7.183601381 | 0.0000114 | 0.000343871 | 3.569359508 | 1.484593545 | 1.484593545 | 1 |
| 234 | 6.76930519 | 0.00002 | 0.000275509 | 2.919119461 | 1.421504522 | 1.421504522 | 1 |
| 235 | 5.023701341 | 0.000302143 | 0.003156934 | 0.207244146 | 1.433771083 | 1.433771083 | 1 |
| 236 | 6.962565132 | 0.0000152 | 0.000230098 | 3.201931954 | 1.585669396 | 1.585669396 | 1 |
| 237 | 6.983966017 | 0.0000148 | 0.000225351 | 3.232936444 | 1.431528005 | 1.431528005 | 1 |
| 238 | 18.50468762 | 0.000000000353 | 0.000000594 | 13.79815085 | 1.412899731 | 1.412899731 | 1 |
| 239 | 6.836518154 | 0.0000186 | 0.000474473 | 3.073310213 | 1.483644766 | 1.483644766 | 1 |
| 240 | 11.79647986 | 0.0000000594 | 0.0000073 | 8.863726458 | 1.424859454 | 1.424859454 | 1 |

TABLE 4.b5

| | Loop Detected | Probe sequence 60 mer | Probe Location Chr |
|---|---|---|---|
| 121 | sHC | TTTACTGGTGTAGATATGATCTTAGTACTCGACTATGTCTGGATTAAAAAATCTTTGTGA (SEQ ID NO: 3242) | 2 |
| 122 | mHC | AATATATTTCTAAAATATGTAAATATATTCGAATGCTGGAAACCAATGAAAATATTGAAA (SEQ ID NO: 3243) | X |

TABLE 4.b5-continued

| | Loop Detected | Probe sequence 60 mer | Probe Location Chr |
|---|---|---|---|
| 123 | mHC | CTTAATCAATTGGAGTTTAACCTTTGGTTCGATAGACGATGTGAACAAATGGAATGAACT (SEQ ID NO: 3244) | 1 |
| 124 | sHC | GAAAAAAATAAAGAGGAAATGAAATATTCGAGACCAGTCTTGAAACCCTATGTCTACTA (SEQ ID NO: 3245) | 3 |
| 125 | sHC | AATAGATATACAACTGGTTATTGCAGCATCGAACTCCTGACCTCAGGCAGTCACCTTCTT (SEQ ID NO: 3246) | 5 |
| 126 | sHC | ATGAAAGGAAAAATTGATAAATTTTTCATCGAACAGTAATTCTGAAATTACTGTCTTATA (SEQ ID NO: 3247) | 8 |
| 127 | mHC | AAATATTCTTAAACCAAATATTTACCTATCGACTAAAGTTTCTCTATTACACTATTTCAT (SEQ ID NO: 3248) | 4 |
| 128 | mHC | GTATCACCCCTGGCCATTACATTATCCATCGACCTCAATTCTAAACAAGTGCTTCTTATT (SEQ ID NO: 3249) | 1 |
| 129 | sHC | ACTACAAATTTTATATGCTTACTGAATATCGATAAATCAATTGGCTAAGTAAGTGATTGA (SEQ ID NO: 3250) | 1 |
| 130 | sHC | TCAGTTCTAGGAAAATTAAGTTACATCTTCGAGGTTCCAGAGACTAGACCTTGAAATAGT (SEQ ID NO: 3251) | 1 |
| 131 | mHC | AAATGTGTGTGAGGGGAGAAAGCTTTGCTCGATAGACTATTAATTAAAAAATAAACTTTT (SEQ ID NO: 3252) | 12 |
| 132 | mHC | AAATGTGTGTGAGGGGAGAAAGCTTTGCTCGAAAGCAAACTGTCAGCCTTTCTGGGGGAA (SEQ ID NO: 3253) | 12 |
| 133 | sHC | CATTITTACAAGGAAAGGACTTTACTCTTCGAATCTCATTTGTTTTCTTAGCTGAGAAAA (SEQ ID NO: 3254) | 2 |
| 134 | mHC | AGATTTTTTTTTTTTAAAATGATTTCAATCGAATTCTATTATAAACATGAAAGTGTCTGT (SEQ ID NO: 3255) | 2 |
| 135 | mHC | AATTTTGTGTTACTATTCTCCATCCTAATCGATTTCTCTTTTTCCATTATCCCTCATCCA (SEQ ID NO: 3256) | 4 |
| 136 | sHC | CATTCTTTTCGTTTGAATTTGTCTTTCCTCGAGGAGCTTATTTTAAGTCTTTTTACTGAG (SEQ ID NO: 3257) | 6 |
| 137 | mHC | GGTATTTCTTTTATGTATGATATATTCTTCGAACATGTTTTAGTGATTTATATTCACTCA (SEQ ID NO: 3258) | 6 |
| 138 | sHC | CCTAATTTCTCTGAGTACAACTTCCTTATCGAACTCCTGACCTCAGGTTTTCTACCCGCC (SEQ ID NO: 3259) | 8 |
| 139 | mHC | CACACTTGAGCTCATTGTAAACCAAAGCTCGAGAGCGGTCCCGTGGGGGCGGTGTTACTC (SEQ ID NO: 200) | X |
| 140 | sHC | GGAGGGGTGATCACTTAAGGTCAGGAGTTCGAACTCCTGGGCCCAAGCAGTCTTTCCACC (SEQ ID NO: 3261) | 6 |
| 141 | mHC | CCTCAGCATTCCATTCCAATCCTTTCTCTCGAACAGAGAACCTACTCAAATCCTGTGCAA (SEQ ID NO: 3262) | Y |
| 142 | sHC | TCATAAAATAATAATTAACAAACATACATCGAAAATATTTGACATAGTTGATCACTTCCT (SEQ ID NO: 3263) | 2 |
| 143 | sHC | AATTGTTCATTGTGGATATTTCAGCCCATCGAAGAAAATGCTGAAGAATATCTTAATGAC (SEQ ID NO: 3264) | 5 |
| 144 | sHC | AAAGATACAATAATTCTAAATTAAAGCTTCGACTTTAACTATGATTATATCATTGCACAA (SEQ ID NO: 3265) | 5 |
| 145 | sHC | AATTGTTCATTGTGGATATTTCAGCCCATCGATCTTAACATTCAAAATCAAAACCTTGAC (SEQ ID NO: 3266) | 5 |
| 146 | mHC | TAAACACATTTTTAAAAAAGATACATGATCGACGTATATTCAGTCCAAAAAAAAAAAAAA (SEQ ID NO: 3267) | 8 |
| 147 | sHC | AATCTCTATCATGATATAAATTTATAAGTCGAAAAACAAAAATAATAAATGCAATATTGA (SEQ ID NO: 3268) | 12 |
| 148 | mHC | GGGCGCGGGTCTGCGGAGCCCCCAGGGCTCGAAACCTGTCTGGCCAACATGGCAAAACTC | 2 |

TABLE 4.b5-continued

| | Loop Detected | Probe sequence 60 mer | Probe Location Chr |
|---|---|---|---|
| | | (SEQ ID NO: 3269) | |
| 149 | mHC | GCCCCAGGTGTGTTGTGTTTGTTTCATGTCGACTGATTGATCAATTTAGTCCTTCTTGAG (SEQ ID NO: 3270) | 16 |
| 150 | mHC | CCTCAGCATTCCATTCCAATCCTTTCTCTCGAGTTCAGGAAATTCTCTTCTATTCCCAGT (SEQ ID NO: 3271) | Y |
| 151 | mHC | CTTAATCAATTGGAGTTTAACCTTTGGTTCGATTTATAACAAAAATAAACACTGTAGAAA (SEQ ID NO: 3272) | 1 |
| 152 | mHC | GCCCCAGGTGTGTTGTGTTTGTTTCATGTCGAAACATTACTCATCCACCAACACCTTGGC (SEQ ID NO: 3273) | 16 |
| 153 | sHC | TTTCTTGTATTTCATTATGTACATCTATTCGAGTTTTATATAAATTCAATCATATTTAAG (SEQ ID NO: 3274) | 6 |
| 154 | sHC | AAGTTACAGGCGTCACCAAAGTTTAGGCTCGAGGCCGCAGTAAGCTGTGTTCACACCACT (SEQ ID NO: 3275) | 9 |
| 155 | mHC | CCTTTTATCCCTGAGCCATTGAAATGGTTCGAAACCATCCTTACCCCTATTTAATGTAGT (SEQ ID NO: 3276) | X |
| 156 | mHC | ATTTGAGAAATAAAATGTTTCATTTTTATCGAAAACTATTAATTTTTAAAAATGTAAGTG (SEQ ID NO: 3277) | 10 |
| 157 | sHC | CATTCTTTTCGTTTGAATTTGTCTTTCCTCGAGATGTACTTTAGATGTAAAATACATACC (SEQ ID NO: 3278) | 6 |
| 158 | sHC | CAGTAATCCTAGAAAGACAACTGATACATCGATTCTCGGAGGGTAACATTAAATGCCAAT (SEQ ID NO: 3279) | 8 |
| 159 | mHC | CTCCATAGCTGATGATAGGAACTGTTTATCGATGTTAGACTGAATAAAGAAAATGTAGCA (SEQ ID NO: 3280) | 9 |
| 160 | sHC | AATGTAAAGGAGTGAATCATTCAGATATTCGAAAAAGATATATAAAGCAATAATTAACAG (SEQ ID NO: 3281) | X |
| 161 | sHC | AAGGAACTTTTGGAGACATTTAGTGATATCGAAGCATTACTTTTGCCTTTCAACCCATGC (SEQ ID NO: 3282) | X |
| 162 | sHC | TTCTTTTGTGCTAAAATATAGAAAGTAATCGACTAATCAGGTAGGTCTGGGTACTTTCAC (SEQ ID NO: 3283) | 10 |
| 163 | sHC | TGTCTTGAGGCTTACTAGTGCACTCCCGTCGAGAAATCTTCACTTTTCTATGCAAGCACA (SEQ ID NO: 3284) | 7 |
| 164 | mHC | ATCACTGTGTGCACAGGTGTGTGTGCTTTCGATTGGGCAGTTTCACTTCCATGTTCCAGA (SEQ ID NO: 3285) | 6 |
| 165 | mHC | AAGAGAGGTGGGGACATTGTGAACTGAATCGAACAAGTGAGGGAAGTTCTGGGAAATCAG (SEQ ID NO: 3286) | 8 |
| 166 | sHC | AAGTTCTAAGGAAGAAAAGAGTCTCCTTTCGAGTATTCTGTTCAACATTGTATCCTAAGT (SEQ ID NO: 3287) | 11 |
| 167 | mHC | ACAGGTATTAGGGTGTTTATTTTGCTTCTCGAATTATATATCAAAGACCATAAGTTCTCA (SEQ ID NO: 3288) | 12 |
| 168 | sHC | AATCTTTTTTCATAAAATGAAGAATAACTCGATGAGTTTCTGTATTCAGGATTGGTGTTT (SEQ ID NO: 3289) | 12 |
| 169 | mHC | TTAAAGAAAAGCCTATAATTTGAAGAATTCGATTTTAGTATGACAACTAAGAACATAAAA (SEQ ID NO: 3290) | 15 |
| 170 | mHC | CCTGTGCAAAGTATGACTCTAGTAACATTCGAGATATGACTATCTTTCAGAGAAGCACTA (SEQ ID NO: 3291) | X |
| 171 | mHC | CATATTCCTAAAATAAATTATACATGCTTCGATAAAAATGTACTTCAAAAATTGGATTGG (SEQ ID NO: 3292) | 5 |
| 172 | mHC | AGGCAGATAACAAAACCATCCCACCGCATCGATCTTTTCATGACGCGTTTTCCTTCTGTG (SEQ ID NO: 3293) | 6 |
| 173 | mHC | TATAAAAATAAAAATAATATATGAATTATCGAGTCCTCAATAAATATTTGCCAAAAACCA (SEQ ID NO: 3294) | 4 |

TABLE 4.b5-continued

| | Loop Detected | Probe sequence 60 mer | Probe Location Chr |
|---|---|---|---|
| 174 | mHC | AAGAGAGGTGGGGACATTGTGAACTGAATCGAATAGGATATACCAATGTGGACTTGTCTG (SEQ ID NO: 3295) | 8 |
| 175 | mHC | GTATCACCCCTGGCCATTACATTATCCATCGAACCAACTTCAAATAAGGCAAACACCAAG (SEQ ID NO: 2986) | 1 |
| 176 | mHC | GTATCACCCCTGGCCATTACATTATCCATCGAAAGTTTAAACTGCCAGCCAAACTTTGTG (SEQ ID NO: 3297) | 1 |
| 177 | sHC | GGCGGATCACCTGATGTCAGTCAGGAGTTCGATCACATTGATTTAAATTACAGGGACCTT (SEQ ID NO: 3298) | 12 |
| 178 | mHC | GTTTATCTGCTAGCTAGGATTTATATAATCGAGCATTTATATACAATAGCAAATCATCCA (SEQ ID NO: 3299) | 13 |
| 179 | mHC | AATTTGTTCGTTAGGTTAAATTAACATATCGATTCACTAGAATTTTCCTATTTGATGATT (SEQ ID NO: 3300) | 15 |
| 180 | mHC | GCCCCAGGTGTGTTGTGTTTGTTTCATGTCGAAACATTACTCATCCACCAACACCTTGGC (SEQ ID NO: 3273) | 16 |
| 181 | mHC | CAACTTCACAACATGAAGTCATTCAATATCGATTITAGGTTCCTTTCCCCAGTCAGTCCA (SEQ ID NO: 3302) | 2 |
| 182 | mHC | CTCCATAGCTGATGATAGGAACTGTTTATCGAGTTGTATTGTTTCTATTTTCCATTCAGT (SEQ ID NO: 3303) | 9 |
| 183 | sHC | AGGCAGGTGAATCACTTGAGATCAGAGTTCGACACAGAAAAAGAGAAATATGAGATTATG (SEQ ID NO: 3304) | X |
| 184 | sHC | TTCGTCTATTGAGAGTTTTTGACATGAATCGACTAAACAAGCAAGAAAAATTAAAAACAA (SEQ ID NO: 3305) | X |
| 185 | mHC | ATTCACATAAAAAACTTTTTTGTGAACATCGATGAACGTGGAATATATTTCAATTTTTTT (SEQ ID NO: 3306) | 3 |
| 186 | mHC | ACTGAAATGTTTTTTTAAATCAGTGGTGTCGAGGTGATGAAGTCTGATCTGTGTCAAGCC (SEQ ID NO: 3307) | 6 |
| 187 | mHC | AATAAAGAAAAAAATCTTCTAAAATAATTCGATAACTTTCTTCCCTGAAAGGGTTAAAAA (SEQ ID NO: 3308) | 8 |
| 188 | sHC | TCTAGGAGAATTCTTTACTCCAATTACTTCGAAATTAAGGAACCTCCTACTTTTTACATC (SEQ ID NO: 3309) | 12 |
| 189 | mHC | AGGTAATTAAGACAAGAAAGACATTTATTCGATTTCTTTATCAGAAGAGTAAAGCAAGCA (SEQ ID NO: 3310) | 2 |
| 190 | sHC | GTTCTTTAGTCTGAACCTTCCTTTCCAGTCGAGGCCGCAGTAAGCTGTGTTCACACCACT (SEQ ID NO: 3311) | 9 |
| 191 | mHC | ATATGCTTTTTTTAAATTACAAAACTTATCGAAACTGGTGGATCCACCAGGTTGAAGGAG (SEQ ID NO: 3312) | 12 |
| 192 | mHC | AAGAGAGGTGGGGACATTGTGAACTGAATCGAATGGAAAGGCCCTTTTTAGACAACTAAT (SEQ ID NO: 3313) | 8 |
| 193 | mHC | GAGATTTTCTTAAGACGGTAATTCTTAATCGAGACTTCTTTTTATAACCAAATAATTTTA (SEQ ID NO: 3314) | 2 |
| 194 | sHC | AATTATGGTAATGTGTTCTCTTCATCCTTCGAATTTAGAGATGAACACACGTTCTGCCTC (SEQ ID NO: 3315) | 6 |
| 195 | mHC | TATGTTGTCAATTTAATCTCAAATTATCTCGATACCTATTATTGTTTATCTTTTTTATTA (SEQ ID NO: 3316) | 2 |
| 196 | sHC | AAGGCAGGCATATCATGAGGTCAGAAGATCGATCTTTCTATGGTGCATTTTCAGAGATGT (SEQ ID NO: 3317) | 3 |
| 197 | mHC | AAGAGAGGTGGGGACATTGTGAACTGAATCGATGCCAAACAGCTGGAACTCTCAAATCAC (SEQ ID NO: 3318) | 8 |
| 198 | mHC | ATTTTTAATTATTAAAAAATAATGTTTTTCGATTACTTTACTGGATTGTCTCACAGAACT (SEQ ID NO: 3319) | 2 |

TABLE 4.b5-continued

| | Loop Detected | Probe sequence 60 mer | Probe Location Chr |
|---|---|---|---|
| 199 | mHC | GTATCACCCCTGGCCATTACATTATCCATCGAGGTCATCAGAGGTCCACAACTTTAGGGA (SEQ ID NO: 3320) | 1 |
| 200 | sHC | ATCTATTTGGCTTATGAATTACCCAGTATCGATGAATCAACATTTTCCAAAATAATACAT (SEQ ID NO: 3321) | 12 |
| 201 | sHC | CATTTTTACAAGGAAAGGACTTTACTCTTCGACATTACTTTTTGTTTTCATTCCTACACT (SEQ ID NO: 3322) | 2 |
| 202 | mHC | TTTATATTTTTATTTTCTATAACATACCTCGATTTTTACAAGAAATTTAAAAATTAGCTT (SEQ ID NO: 3323) | 2 |
| 203 | sHC | GGCCGGCAGATCACTTCAGGTCAAGAGTTCGATGATGATATAGGCATTAAAACATGAGTT (SEQ ID NO: 2889) | 21 |
| 204 | mHC | TAAAACTATTTTAAATGTTTTTAAAGTATCGAAAACTAAATCTCTAATCTCTAACCTTTC (SEQ ID NO: 3325) | 4 |
| 205 | sHC | CATTCTTTTCGTTTGAATTTGTCTTTCCTCGAGGAGCTTATTTTAAGTCTTTTTACTGAG (SEQ ID NO: 3257) | 6 |
| 206 | sHC | CTAACATAAAATAAACCTCTTACAAATTTCGATGATGTTCAAAAATAGTAGATTAAACCA (SEQ ID NO: 3327) | 6 |
| 207 | sHC | TCTTGTCTGAAATCATCAAGGCAGTACCTCGAGTCTCCTTTTGGATATTTTCTTCCAAAA (SEQ ID NO: 3328) | X |
| 208 | sHC | TTTACTGGTGTAGATATGATCTTAGTACTCGAGTGGTAATGTACCAATCATTCATTGATT (SEQ ID NO: 3329) | 2 |
| 209 | sHC | TGAAAATATTGTACTTATATTAAATTAATCGAACTCCTAGTCTCAAGTGATCCACCTGTC (SEQ ID NO: 3330) | 22 |
| 210 | sHC | CTCTGCATTTATTGTAAACTATCTTAAATCGAAGTTGGTAAGTTGGTTTCTAAACATTTT (SEQ ID NO: 3331) | 8 |
| 211 | sHC | GGTGGGTAGATCACCTGAGGTCAGGAGTTCGAACTCCTAACCTCAGGTGATCTACCCACT (SEQ ID NO: 3332) | 1 |
| 212 | mHC | ATTTGAGAAATAAAATGTTTCATTTTTATCGATCATATATATATATATATATATATATAC (SEQ ID NO: 3333) | 10 |
| 213 | sHC | AATTCTTCCCTAAGGATATTTATTAACTTCGATAACTACAAAGAAACTAAAAACGCTACC (SEQ ID NO: 3334) | 11 |
| 214 | mHC | TTATTTGAAAACAACGTCAAGAGAAGGCTCGATGGGAGGCATGACAGAAATTATATTAAT (SEQ ID NO: 3335) | 5 |
| 215 | sHC | GGCCAAGTCTTTAGAGAGTTGTGATCACTCGAAGGTATTAAAATCTTCAACTAAAATACT (SEQ ID NO: 3336) | 17 |
| 216 | mHC | TTTCTTGTATTTCATTATGTACATCTATTCGATTATAAGCTAACATTGAAGGTATTCGTA (SEQ ID NO: 3337) | 6 |
| 217 | mHC | GAGGCGGGTGATTCACAAGGTCAGATGTTCGAAATTGTGTAAATAAGCATTTGCAGCCCT (SEQ ID NO: 3338) | 6 |
| 218 | mHC | CTGCAGGTGTGTGCATTAAGGAGCAACTTCGAGACAATCCTGGTCAACATGGTGAAACCC (SEQ ID NO: 3339) | 1 |
| 219 | mHC | GTATCACCCCTGGCCATTACATTATCCATCGATAAGGATTCTATAGAGTCAGATTCTCTA (SEQ ID NO: 2895) | 1 |
| 220 | sHC | GGCAGGTGGATCTCTTGAGGTCAGAAGTTCGAGTCACCAAATGAGGAATCTAAAATAGCC (SEQ ID NO: 3341) | 1 |
| 221 | mHC | AAATGTGTGTGAGGGGAGAAAGCTTTGCTCGATTTAATTGCAGTGGTCATATTAGCTTCC (SEQ ID NO: 3342) | 12 |
| 222 | mHC | TGTATACCAAATAAATCAAATAAATAAATCGATTGAGTAGGTTTTATGTTGATTGGTTGG (SEQ ID NO: 3343) | 15 |
| 223 | sHC | TAATCTCCTCAAGTATACCATAAATTATTCGACCAGGAGTAAACATAGTTAAATGAATAA (SEQ ID NO: 3344) | 18 |
| 224 | sHC | CTATATTGTAGCTCTATTTTCTCTAAATTCGACAACTTTACTTCTATGTATTATGATCCT (SEQ | 2 |

TABLE 4.b5-continued

| Loop Detected | Probe sequence 60 mer | Probe Location Chr |
|---|---|---|
| | ID NO: 3345) | |
| 225 sHC | GGCCGGCAGATCACTTCAGGTCAAGAGTTCGACTTCCTTAAAGTTTCATTTTGATGAAGT (SEQ ID NO: 2888) | 21 |
| 226 mHC | TTCAATTGTACTGTTAATATTTTATTTCTCGAATAAATAATCCTCTTCTTTTCCTCTTTC (SEQ ID NO: 668) | 5 |
| 227 mHC | CACACTTGAGCTCATTGTAAACCAAAGCTCGAGAGCGGTCCCGTGGGGGCGGTGTTACTC (SEQ ID NO: 200) | X |
| 228 mHC | CTGCAGGTGTGTGCATTAAGGAGCAACTTCGAAAAGTCCAGAATGAACTCCAAAGATTGA (SEQ ID NO: 3349) | 1 |
| 229 sHC | GAAGCAGAGATGTTTTCAGTTACAAAGCTCGACATTTTGAATATGTGGGATCCAAATCTG (SEQ ID NO: 3350) | 17 |
| 230 mHC | TGTAACAGATCCTTAAAAAAAAATAAAATCGAATTATAGCTCTTTATAGGAAATGTTCAC (SEQ ID NO: 3351) | 4 |
| 231 mHC | AAGAGAGGTGGGGACATTGTGAACTGAATCGATTGCTGTCCATGTCCATTGGCACTTGGC (SEQ ID NO: 3352) | 8 |
| 232 mHC | TTTTTAAAGAAGGTTTGTATCATATTTCTCGATATTATTCTATCAGTCCTGCAGTCCTGT (SEQ ID NO: 340) | 19 |
| 233 mHC | GCCCACTAAATAGTAATATTAGGATCTATCGAAATTTAACTTGTAACTCAAGTAAAATTG (SEQ ID NO: 3354) | 9 |
| 234 sHC | ATTACCCATATACATATCGTATATAAAATCGAAACCTCTATTTTCAGGTAGCCATTATGA (SEQ ID NO: 3355) | 4 |
| 235 mHC | AAGAGAGGTGGGGACATTGTGAACTGAATCGACCCCAGGGTAAAAGTTAGCTATTCTAAA (SEQ ID NO: 3356) | 8 |
| 236 sHC | AACTAAAATCTCCCACAAGGGAAAACCTTCGAGGCCGCAGTAAGCTGTGTTCACACCACT (SEQ ID NO: 3357) | 9 |
| 237 sHC | CGTCTTTCCTTTAGGGCTTCATTTAACTTCGATTGTTCTTTTACTATTATTCACTCTTGG (SEQ ID NO: 3358) | X |
| 238 sHC | GGCTGGCAGATCACTTGAGGCCAGTAGTTCGAATGAGGAATACATGTTTATTTGAATAGC (SEQ ID NO: 3359) | 13 |
| 239 mHC | AATATACATAAAAGTTACTTTTTTTTTTTCGAAACTTATGTCACAGAAAAAAAGCAGTAA (SEQ ID NO: 3360) | 14 |
| 240 sHC | CTATTTCAACAAAAAAACTCATTTAAAATCGAAGTATGGTTTATATTATGACATTATGTC (SEQ ID NO: 3361) | 2 |

TABLE 4.b6

| | Probe Location | | | | 4 kb Sequence Location | | | |
|---|---|---|---|---|---|---|---|---|
| | Start1 | End1 | Start2 | End2 | Chr | Start1 | End1 | Start2 | End2 |
| 121 | 56316547 | 56316578 | 56347853 | 56347884 | 2 | 56312577 | 56316578 | 56343883 | 56347884 |
| 122 | 103111808 | 103111839 | 103163519 | 103163550 | X | 103107838 | 103111839 | 103159549 | 103163550 |
| 123 | 229797491 | 229797522 | 229849427 | 229849458 | 1 | 229793521 | 229797522 | 229849427 | 229853428 |
| 124 | 40983293 | 40983324 | 41025836 | 41025867 | 3 | 40979323 | 40983324 | 41025836 | 41029837 |
| 125 | 56055669 | 56055700 | 56069488 | 56069519 | 5 | 56051699 | 56055700 | 56069488 | 56073489 |
| 126 | 22342734 | 22342765 | 22373651 | 22373682 | 8 | 22338764 | 22342765 | 22369681 | 22373682 |
| 127 | 88282468 | 88282499 | 88335985 | 88336016 | 4 | 88278498 | 88282499 | 88335985 | 88339986 |
| 128 | 110164010 | 110164041 | 110248816 | 110248847 | 1 | 110160040 | 110164041 | 110244846 | 110248847 |
| 129 | 186762629 | 186762660 | 186824303 | 186824334 | 1 | 186762629 | 186766630 | 186820333 | 186824334 |
| 130 | 210312443 | 210312474 | 210344738 | 210344769 | 1 | 210312443 | 210316444 | 210344738 | 210348739 |
| 131 | 13269291 | 13269322 | 13314367 | 13314398 | 12 | 13269291 | 13273292 | 13310397 | 13314398 |
| 132 | 13314367 | 13314398 | 13342225 | 13342256 | 12 | 13310397 | 13314398 | 13342225 | 13346226 |
| 133 | 11479893 | 11479924 | 11535514 | 11535545 | 2 | 11479893 | 11483894 | 11531544 | 11535545 |
| 134 | 5932311 | 5932342 | 5980282 | 5980313 | 2 | 5928341 | 5932342 | 5976312 | 5980313 |
| 135 | 37859966 | 37859997 | 37914414 | 37914445 | 4 | 37859966 | 37863967 | 37914414 | 37918415 |
| 136 | 134212503 | 134212534 | 134271335 | 134271366 | 6 | 134212503 | 134216504 | 134267365 | 134271366 |
| 137 | 84755923 | 84755954 | 84786605 | 84786636 | 6 | 84751953 | 84755954 | 84782635 | 84786636 |

TABLE 4.b6-continued

| | Probe Location | | | | 4 kb Sequence Location | | | | |
|---|---|---|---|---|---|---|---|---|---|
| | Start1 | End1 | Start2 | End2 | Chr | Start1 | End1 | Start2 | End2 |
| 138 | 119857282 | 119857313 | 119882110 | 119882141 | 8 | 119853312 | 119857313 | 119882110 | 119886111 |
| 139 | 115878688 | 115878719 | 115945548 | 115945579 | X | 115878688 | 115882689 | 115941578 | 115945579 |
| 140 | 89493632 | 89493663 | 89550722 | 89550753 | 6 | 89493632 | 89497633 | 89546752 | 89550753 |
| 141 | 11009126 | 11009157 | 11075743 | 11075774 | Y | 11005126 | 11009157 | 11075743 | 11079744 |
| 142 | 38155445 | 38155476 | 38179203 | 38179234 | 2 | 38151475 | 38155476 | 38179203 | 38183204 |
| 143 | 26963456 | 26963487 | 26999889 | 26999920 | 5 | 26959486 | 26963487 | 26999889 | 27003890 |
| 144 | 38611059 | 38611090 | 38683282 | 38683313 | 5 | 38607089 | 38611090 | 38679312 | 38683313 |
| 145 | 26963456 | 26963487 | 27004713 | 27004744 | 5 | 26959486 | 26963487 | 27000743 | 27004744 |
| 146 | 29147602 | 29147633 | 29216944 | 29216975 | 8 | 29143632 | 29147633 | 29216944 | 29220945 |
| 147 | 82575759 | 82575790 | 82624217 | 82624248 | 12 | 82571789 | 82575790 | 82624217 | 82628218 |
| 148 | 27495025 | 27495056 | 27545211 | 27545242 | 2 | 27491055 | 27495056 | 27541241 | 27545242 |
| 149 | 11990167 | 11990198 | 12005204 | 12005235 | 16 | 11986197 | 11990198 | 12005204 | 12009205 |
| 150 | 11009126 | 11009157 | 11075712 | 11075743 | Y | 11005126 | 11009157 | 11071742 | 11075743 |
| 151 | 229797491 | 229797522 | 229859020 | 229859051 | 1 | 229793521 | 229797522 | 229859020 | 229863021 |
| 152 | 11990167 | 11990198 | 12009229 | 12009260 | 16 | 11986197 | 11990198 | 12005259 | 12009260 |
| 153 | 73669509 | 73669540 | 73690117 | 73690148 | 6 | 73669509 | 73673510 | 73686147 | 73690148 |
| 154 | 33299656 | 33299687 | 33317596 | 33317627 | 9 | 33299656 | 33303657 | 33317596 | 33321597 |
| 155 | 103336904 | 103336935 | 103357970 | 103358001 | X | 103336904 | 103340905 | 103357970 | 103361971 |
| 156 | 89864618 | 89864649 | 89926184 | 89926215 | 10 | 89860648 | 89864649 | 89922214 | 89926215 |
| 157 | 134271335 | 134271366 | 134289631 | 134289662 | 6 | 134267365 | 134271366 | 134285661 | 134289662 |
| 158 | 21022651 | 21022682 | 21074365 | 21074396 | 8 | 21022651 | 21026652 | 21074365 | 21078366 |
| 159 | 94791100 | 94791131 | 94822711 | 94822742 | 9 | 94791100 | 94795101 | 94818741 | 94822742 |
| 160 | 118719838 | 118719869 | 118775165 | 118775196 | X | 118719838 | 118723839 | 118771195 | 118775196 |
| 161 | 134227323 | 134227354 | 134251763 | 134251794 | X | 134227323 | 134231324 | 134251763 | 134255764 |
| 162 | 110775235 | 110775266 | 110797638 | 110797669 | 10 | 110775235 | 110779236 | 110797638 | 110801639 |
| 163 | 22396847 | 22396878 | 22452771 | 22452802 | 7 | 22392877 | 22396878 | 22452771 | 22456772 |
| 164 | 37604858 | 37604889 | 37631492 | 37631523 | 6 | 37600888 | 37604889 | 37627522 | 37631523 |
| 165 | 97888636 | 97888667 | 97937368 | 97937399 | 8 | 97884666 | 97888667 | 97933398 | 97937399 |
| 166 | 102000275 | 102000306 | 102027848 | 102027879 | 11 | 101996305 | 102000306 | 102023878 | 102027879 |
| 167 | 54591576 | 54591607 | 54623187 | 54623218 | 12 | 54587606 | 54591607 | 54623187 | 54627188 |
| 168 | 46922957 | 46922988 | 46952555 | 46952586 | 12 | 46922957 | 46926958 | 46952555 | 46956556 |
| 169 | 65512147 | 65512178 | 65573794 | 65573825 | 15 | 65512147 | 65516148 | 65573794 | 65577795 |
| 170 | 11366661 | 11366692 | 11459265 | 11459296 | X | 11366661 | 11370692 | 11459265 | 11463266 |
| 171 | 7555641 | 7555672 | 7606244 | 7606275 | 5 | 7555641 | 7559642 | 7606244 | 7610245 |
| 172 | 45815741 | 45815772 | 45845191 | 45845222 | 6 | 45815741 | 45819742 | 45845191 | 45849192 |
| 173 | 21879694 | 21879725 | 21965631 | 21965662 | 4 | 21879694 | 21883695 | 21965631 | 21969632 |
| 174 | 97888636 | 97888667 | 97933550 | 97933581 | 8 | 97884666 | 97888667 | 97933550 | 97937551 |
| 175 | 110164010 | 110164041 | 110187380 | 110187411 | 1 | 110160040 | 110164041 | 110183410 | 110187411 |
| 176 | 110164010 | 110164041 | 110248847 | 110248878 | 1 | 110160040 | 110164041 | 110248847 | 110252848 |
| 177 | 16574208 | 16574239 | 16637234 | 16637265 | 12 | 16574208 | 16578209 | 16633264 | 16637265 |
| 178 | 53036652 | 53036683 | 53050162 | 53050193 | 13 | 53032682 | 53036683 | 53046192 | 53050193 |
| 179 | 22835609 | 22835640 | 22893089 | 22893120 | 15 | 22835609 | 22835640 | 22889119 | 22893120 |
| 180 | 11990167 | 11990198 | 12009229 | 12009260 | 16 | 11986197 | 11990198 | 12005259 | 12009260 |
| 181 | 169105039 | 169105070 | 169146919 | 169146950 | 2 | 169101069 | 169105070 | 169146919 | 169150920 |
| 182 | 94822711 | 94822742 | 94896134 | 94896165 | 9 | 94818741 | 94822742 | 94892164 | 94896165 |
| 183 | 1174946 | 1174977 | 1242344 | 1242375 | X | 1174947 | 1178947 | 1238374 | 1242375 |
| 184 | 5600895 | 5600926 | 5621246 | 5621277 | X | 5596925 | 5600926 | 5621246 | 5625247 |
| 185 | 106249641 | 106249672 | 106313861 | 106313892 | 3 | 106245671 | 106249672 | 106313861 | 106317862 |
| 186 | 157307294 | 157307325 | 157340005 | 157340036 | 6 | 157307294 | 157311295 | 157336035 | 157340036 |
| 187 | 113381107 | 113381138 | 113436243 | 113436274 | 8 | 113381107 | 113381138 | 113436243 | 113440244 |
| 188 | 26021026 | 26021057 | 26034684 | 26034715 | 12 | 26017056 | 26021057 | 26034684 | 26038685 |
| 189 | 129205308 | 129205339 | 129233271 | 129233302 | 2 | 129205308 | 129209309 | 129229301 | 129233302 |
| 190 | 33260613 | 33260644 | 33317596 | 33317627 | 9 | 33256643 | 33260644 | 33317596 | 33321597 |
| 191 | 96219857 | 96219888 | 96241318 | 96241349 | 12 | 96219857 | 96223858 | 96237348 | 96241349 |
| 192 | 97888636 | 97888667 | 97946210 | 97946241 | 8 | 97884666 | 97888667 | 97942240 | 97946241 |
| 193 | 209662023 | 209662054 | 209738615 | 209738646 | 2 | 209658053 | 209662054 | 209734645 | 209738646 |
| 194 | 61648546 | 61648577 | 61699874 | 61699905 | 6 | 61648546 | 61652547 | 61695904 | 61699905 |
| 195 | 21342478 | 21342509 | 21390529 | 21390560 | 2 | 21342478 | 21346479 | 21386559 | 21390560 |
| 196 | 78745074 | 78745105 | 78759779 | 78759810 | 3 | 78745074 | 78745105 | 78755809 | 78759810 |
| 197 | 97811124 | 97811155 | 97888636 | 97888667 | 8 | 97811124 | 97815125 | 97884666 | 97888667 |
| 198 | 195589030 | 195589061 | 195630259 | 195630290 | 2 | 195585060 | 195589061 | 195630259 | 195634260 |
| 199 | 110164010 | 110164041 | 110272003 | 110272034 | 1 | 110160040 | 110164041 | 110268033 | 110272034 |
| 200 | 83896006 | 83896037 | 83957569 | 83957600 | 12 | 83892036 | 83896037 | 83953599 | 83957600 |
| 201 | 11504797 | 11504828 | 11535514 | 11535545 | 2 | 11504797 | 11508798 | 11531544 | 11535545 |
| 202 | 20297935 | 20297966 | 20328998 | 20329029 | 2 | 20297935 | 20301936 | 20328998 | 20332999 |
| 203 | 17392864 | 17392895 | 17439402 | 17439433 | 21 | 17388894 | 17392895 | 17435432 | 17439433 |
| 204 | 153700318 | 153700349 | 153769067 | 153769098 | 4 | 153696348 | 153700349 | 153765097 | 153769098 |
| 205 | 134212503 | 134212534 | 134271335 | 134271366 | 6 | 134212503 | 134216504 | 134267365 | 134271366 |
| 206 | 162152986 | 162153017 | 162211718 | 162211749 | 6 | 162152986 | 162156987 | 162207748 | 162211749 |
| 207 | 37321219 | 37321250 | 37333766 | 37333797 | X | 37317249 | 37321250 | 37333766 | 37337767 |
| 208 | 56316547 | 56316578 | 56394093 | 56394124 | 2 | 56316547 | 56316578 | 56390123 | 56394124 |
| 209 | 20774362 | 20774393 | 20816159 | 20816190 | 22 | 20770392 | 20774393 | 20816159 | 20820160 |
| 210 | 9126258 | 9126289 | 9220259 | 9220290 | 8 | 9122288 | 9126289 | 9220259 | 9224260 |
| 211 | 211433313 | 211433344 | 211470751 | 211470782 | 1 | 211433313 | 211437314 | 211466781 | 211470782 |
| 212 | 89827266 | 89827297 | 89864618 | 89864649 | 10 | 89827266 | 89831267 | 89860648 | 89864649 |
| 213 | 75864693 | 75864724 | 75943194 | 75943225 | 11 | 75860723 | 75864724 | 75939224 | 75943225 |

TABLE 4.b6-continued

| | Probe Location | | | | 4 kb Sequence Location | | | |
|---|---|---|---|---|---|---|---|---|
| | Start1 | End1 | Start2 | End2 | Chr | Start1 | End1 | Start2 | End2 |
| 214 | 167858519 | 167858550 | 167921706 | 167921737 | 5 | 167854549 | 167858550 | 167921706 | 167925707 |
| 215 | 16800716 | 16800747 | 16884815 | 16884846 | 17 | 16796746 | 16800747 | 16880845 | 16884846 |
| 216 | 73690117 | 73690148 | 73749995 | 73750026 | 6 | 73686147 | 73690148 | 73746025 | 73750026 |
| 217 | 151449133 | 151449164 | 151538545 | 151538576 | 6 | 151445163 | 151449164 | 151534575 | 151538576 |
| 218 | 48539737 | 48539768 | 48603267 | 48603298 | 1 | 48535767 | 48539768 | 48603267 | 48607268 |
| 219 | 110141802 | 110141833 | 110164010 | 110164041 | 1 | 110141802 | 110145803 | 110160040 | 110164041 |
| 220 | 223787115 | 223787146 | 223834661 | 223834692 | 1 | 223787115 | 223791116 | 223834661 | 223838662 |
| 221 | 13270343 | 13270374 | 13314367 | 13314398 | 12 | 13270343 | 13274344 | 13310397 | 13314398 |
| 222 | 22839534 | 22839565 | 22886396 | 22886427 | 15 | 22839534 | 22843535 | 22882426 | 22886427 |
| 223 | 12837148 | 12837179 | 12853029 | 12853060 | 18 | 12837148 | 12841149 | 12849059 | 12853060 |
| 224 | 78765418 | 78765449 | 78804372 | 78804403 | 2 | 78761448 | 78765449 | 78804372 | 78808373 |
| 225 | 17392864 | 17392895 | 17435717 | 17435748 | 21 | 17388894 | 17392895 | 17431747 | 17435748 |
| 226 | 93565548 | 93565579 | 93583739 | 93583770 | 5 | 93561578 | 93565579 | 93579769 | 93583770 |
| 227 | 115872740 | 115872771 | 115945548 | 115945579 | X | 115872740 | 115876741 | 115941578 | 115945579 |
| 228 | 48539737 | 48539768 | 48618771 | 48618802 | 1 | 48535767 | 48539768 | 48614801 | 48618802 |
| 229 | 36192362 | 36192393 | 36216401 | 36216432 | 17 | 36192362 | 36196363 | 36216401 | 36220402 |
| 230 | 175635137 | 175635168 | 175665390 | 175665421 | 4 | 175635137 | 175639138 | 175661420 | 175665421 |
| 231 | 97888636 | 97888667 | 97913281 | 97913312 | 8 | 97884666 | 97888667 | 97909311 | 97913312 |
| 232 | 46459835 | 46459866 | 46481483 | 46481514 | 19 | 46459835 | 46463836 | 46477513 | 46481514 |
| 233 | 28339600 | 28339631 | 28379485 | 28379516 | 9 | 28335630 | 28339631 | 28375515 | 28379516 |
| 234 | 15556941 | 15556972 | 15665131 | 15665162 | 4 | 15556941 | 15560942 | 15665131 | 15669132 |
| 235 | 97888636 | 97888667 | 97955459 | 97955490 | 8 | 97884666 | 97888667 | 97955459 | 97959460 |
| 236 | 33260644 | 33260675 | 33317596 | 33317627 | 9 | 33260644 | 33264645 | 33317596 | 33321597 |
| 237 | 101078729 | 101078760 | 101109398 | 101109429 | X | 101074759 | 101078760 | 101105428 | 101109429 |
| 238 | 45792577 | 45792608 | 45859224 | 45859255 | 13 | 45792577 | 45796578 | 45859224 | 45863225 |
| 239 | 73418771 | 73418802 | 73454993 | 73455024 | 14 | 73418771 | 73422772 | 73454993 | 73458994 |
| 240 | 164435438 | 164435469 | 164496617 | 164496648 | 2 | 164431468 | 164435469 | 164492647 | 164496648 |

TABLE 4.b7

| | Probe | PCR-Primer1_ID | PCR_Primer1 |
|---|---|---|---|
| 121 | ORF144_2_56308065_56316578_56344324_56347884_FF | OBD159_2701 | GTCTGAGGACCCACACAAAGGAAC (SEQ ID NO: 3362) |
| 122 | ORF144_X_103107164_103111839_103158530_103163550_FF | OBD159_2705 | GGGATGCCTGGGACATAAGTCAGATG (SEQ ID NO: 484) |
| 123 | ORF146_1_229796281_229797522_229849427_229855718_FR | OBD159_2709 | CACAGCAACAAAAGCAACCTGGTGTC (SEQ ID NO: 1240) |
| 124 | ORF148_3_40973608_40983324_41025836_41032545_FR | OBD159_2713 | GGAGAATACCTACAGGCAGCCCAGAA (SEQ ID NO: 3365) |
| 125 | ORF148_5_56051850_56055700_56069488_56074299_FR | OBD159_2717 | CTGAGTGGAGTAGCGTGGGTGAG (SEQ ID NO: 3366) |
| 126 | ORF148_8_22339630_22342765_22370928_22373682_FF | OBD159_2721 | GGTGGCTTTGGGTTTGGTGATTACTT (SEQ ID NO: 3367) |
| 127 | ORF149_4_88278877_88282499_88335985_88339586_FR | OBD159_2725 | CTTCCACAATGAGAACACAGCCCTTT (SEQ ID NO: 3368) |
| 128 | ORF15_1_110155952_110164041_110243262_110248847_FF | OBD159_2729 | AGAGATGCCCTTCCTGACTGCCC (SEQ ID NO: 3369) |
| 129 | ORF15_1_186762629_186769807_186806428_186824334_RF | OBD159_2733 | GTGGGCTTTGGAGTTGGACCGAC (SEQ ID NO: 3370) |
| 130 | ORF15_1_210312443_210322312_210344738_210348320_RR | OBD159_2737 | CCACAGACATTGGAGGTTGAGTT (SEQ ID NO: 3371) |
| 131 | ORF15_12_13269291_13270343_13311794_13314398_RF | OBD159_2741 | GCGATACTTACGAAAATGAAGCCAGG (SEQ ID NO: 3372) |
| 132 | ORF15_12_13311794_13314398_13342225_13351549_FR | OBD159_2745 | TAGGGTGGGCACAGAAGGGTGGT (SEQ ID NO: 3373) |
| 133 | ORF15_2_11479893_11482767_11532162_11535545_RF | OBD159_2749 | TTTGAAGGTCATCTCAGGAAGGGC (SEQ ID NO: 3374) |
| 134 | ORF15_2_5924503_5932342_5965887_5980313_FF | OBD159_2753 | GGTCTCCAGGTCTCCTTAGTCTCAGT |

TABLE 4.b7-continued

| Probe | PCR-Primer1_ID | PCR_Primer1 |
|---|---|---|
| | | (SEQ ID NO: 3375) |
| 135 ORF15_4_37859966_37862832_37914414_37919908_RR | OBD159_2757 | GAAAATAACAGTTCTCAGGAAGGCAT (SEQ ID NO: 3164) |
| 136 ORF15_6_134212503_134214388_134270140_134271366_RF | OBD159_2761 | GGCAGGAGAATCACTTGAACCTA (SEQ ID NO: 3377) |
| 137 ORF15_6_84752549_84755954_84775145_84786636_FF | OBD159_2765 | TAAGACATTGTTTAGCAACTTCCAA (SEQ ID NO: 3378) |
| 138 ORF15_8_119855069_119857313_119882110_119888009_FR | OBD159_2769 | CTTCAGAACTTTGTGACCTAAGGCAAT (SEQ ID NO: 3379) |
| 139 ORF15_X_115878688_115881423_115936015_115945579_RF | OBD159_2773 | CAGGAATCATTTGACACAATCCCC (SEQ ID NO: 260) |
| 140 ORF150_6_89493632_89495030_89546588_89550753_RF | OBD159_2777 | GGGCTGCTGGATACTGGTTAGTC (SEQ ID NO: 3381) |
| 141 ORF150_Y_11007821_11009157_11075743_11080103_FR | OBD159_2781 | CCACTACAATCCACTTCCACTCCACT (SEQ ID NO: 3382) |
| 142 ORF152_2_38148629_38155476_38179203_38180978_FR | OBD159_2785 | CCCGCCCACATCCTGAGAATCCT (SEQ ID NO: 3383) |
| 143 ORF152_5_26952527_26963487_26999889_27004744_FR | OBD159_2789 | GGCTCTAATCCCCTTTGAGGTGCGAA (SEQ ID NO: 3384) |
| 144 ORF152_5_38608515_38611090_38682143_38683313_FF | OBD159_2793 | AACTGGAGTCTTTCTATGGCTTGAAT (SEQ ID NO: 3385) |
| 145 ORF153_5_26952527_26963487_26999889_27004744_FF | OBD159_2797 | GCTCTAATCCCCTTTGAGGTGCGAAA (SEQ ID NO: 3386) |
| 146 ORF153_8_29144477_29147633_29216944_29221322_FR | OBD159_2801 | TTCGTGCTCATACATAAGCCTCTGGC (SEQ ID NO: 3387) |
| 147 ORF154_12_82572942_82575790_82624217_82631901_FR | OBD159_2805 | GGCAGATAAAGAAAATAGATGTCTCC (SEQ ID NO: 3388) |
| 148 ORF155_2_27492451_27495056_27542894_27545242_FF | OBD159_2809 | TTTTCTCTACGCCCTCCCGCCCC (SEQ ID NO: 3389) |
| 149 ORF156_16_11987495_11990198_12005204_12009260_FR | OBD159_2813 | TCAGTATGGCGGATTGGTGGCGG (SEQ ID NO: 3390) |
| 150 ORF156_Y_11007821_11009157_11057559_11075743_FF | OBD159_2817 | TCCACTCCATTCCATTCCACTGC (SEQ ID NO: 3391) |
| 151 ORF157_1_229796281_229797522_229859020_229862315_FR | OBD159_2821 | CAGCACCAGCAACCACAGCAACA (SEQ ID NO: 3392) |
| 152 ORF158_16_11987495_11990198_12005204_12009260_FF | OBD159_2825 | AGTATGGCGGATTGGTGGCGGGC (SEQ ID NO: 3393) |
| 153 ORF158_6_73669509_73673385_73688989_73690148_RF | OBD159_2829 | TCAGTGTTTGCTTTTCCCTTGAAT (SEQ ID NO: 718) |
| 154 ORF158_9_33299656_33304064_33317596_33319558_RR | OBD159_2833 | GTCTGTTCCACAACCTCTTTCTG (SEQ ID NO: 3395) |
| 155 ORF158_X_103336904_103343604_103357970_103363324_RR | OBD159_2837 | CAACCAATCCAGAACCCATACCACCA (SEQ ID NO: 3396) |
| 156 ORF159_10_89863078_89864649_89921840_89926215_FF | OBD159_2841 | CCCACTGGAGCATAAGATGAACCAAT (SEQ ID NO: 3397) |
| 157 ORF16_6_134270140_134271366_134285274_134289662_FF | OBD159_2845 | TGAGGCAGGAGAATCACTTGAACC (SEQ ID NO: 3398) |
| 158 ORF16_8_21022651_21025530_21074365_21076495_RR | OBD159_2849 | CGGGAGGTTTCTGTGAGAGGTGT (SEQ ID NO: 3399) |
| 159 ORF16_9_94791100_94792692_94818790_94822742_RF | OBD159_2853 | TCTGATTCTCTTCATTGCTCGGAAAT (SEQ ID NO: 3400) |

TABLE 4.b7-continued

| Probe | PCR-Primer1_ID | PCR_Primer1 |
|---|---|---|
| 160 ORF16_X_118719838_118725132_118772495_118775196_RF | OBD159_2857 | CCAAGAAAGTGACATTTGAGGAGAGA (SEQ ID NO: 3401) |
| 161 ORF16 X 134227323_134230233_134251763_134253313_RR | OBD159_2861 | ATGCTCAAGAAGAAGTAATGCCAGGG (SEQ ID NO: 3402) |
| 162 ORF160_10_110775235_110786527_110797638_110800058_RF | OBD159_2865 | TCCAGAAGCAGGAGCCAAGAACCACA (SEQ ID NO: 3403) |
| 163 ORF160_7_22390272_22396878_22452771_22454987_FR | OBD159_2869 | AGGCTCCTGGGTTCCTATGTTCAAAT (SEQ ID NO: 3053) |
| 164 ORF164_6_37603737_37604889_37629301_37631523_FF | OBD159_2873 | TTTGACCAGGAAACAGTGAGAGCAGT (SEQ ID NO: 3405) |
| 165 ORF164_8_97885717_97888667_97935143_97937399_FF | OBD159_2877 | TGTTGTTGGACCTATCTGAGCAAAGG (SEQ ID NO: 3406) |
| 166 ORF166_11_101998219_102000306_102025025_102027879_FR | OBD159_2881 | TGGCAACAGAGCAAGACTCCGTC (SEQ ID NO: 3407) |
| 167 ORF166_12_54589309_54591607_54623187_54631741_FR | OBD159_2885 | TAACCCTCACAACCACCCAGGAG (SEQ ID NO: 3027) |
| 168 ORF167_12_46922957_46926200_46952555_46954006_RR | OBD159_2889 | CTAAGTTCCTGTGTGTCTGTCTTGAC (SEQ ID NO: 3409) |
| 169 ORF167_15_65512147_65515718_65573794_65596385_RR | OBD159_2893 | CAGAATCTATTACCTTGGTGAGTA (SEQ ID NO: 3410) |
| 170 ORF167_X 11366661_11385597_11459265_11462297_RR | OBD159_2897 | CCCTTGTGAAAACTGAACACCACCCC (SEQ ID NO: 3411) |
| 171 ORF168_5_7555641_7557907_7606244_7610178_RR | OBD159_2901 | GGAGCCTAAAGTTATGGGAATGTCAT (SEQ ID NO: 2790) |
| 172 ORF168_6_45815741_45822184_45845191_45849862_RR | OBD159_2905 | CAAGGTGGCAGTTGGCAGTCAGAAAG (SEQ ID NO: 3413) |
| 173 ORF169_4_21879694_21883839_21965631_21973272_RR | OBD159_2909 | GGTGAGGACACAGCGAAACCATA (SEQ ID NO: 3414) |
| 174 ORF169_8_97885717_97888667_97933550_97935143_FR | OBD159_2913 | GGTCCTTGTTGGATGTGCTGGGC (SEQ ID NO: 3415) |
| 175 ORF17_1_110155952_110164041_110184326_110187411_FF | OBD159_2641 | GCATAAAAGAGCCACCTGCCAGC (SEQ ID NO: 3015) |
| 176 ORF17_1_110155952_110164041_110248847_110251734_FR | OBD159_2917 | CCCCGCATCCAGCATAAAAGAGCC (SEQ ID NO: 3417) |
| 177 ORF17_12_16574208_16575957_16629200_16637265_RF | OBD159_2921 | AAAAGCAACCTGGGCTGGGCACG (SEQ ID NO: 3418) |
| 178 ORF17_13_53034265_53036683_53047390_53050193_FF | OBD159_2922 | AAAAGCAACCTGGGCTGGGCACG (SEQ ID NO: 3418) |
| 179 ORF17_15_22830640_22835640_22890866_22893120_FF | OBD159_2923 | AAAAGCAACCTGGGCTGGGCACG (SEQ ID NO: 3418) |
| 180 ORF17_16_11987495_11990198_12005204_12009260_FF | OBD159_2825 | AGTATGGCGGATTGGTGGCGGGC (SEQ ID NO: 3393) |
| 181 ORF17_2_169092304_169105070_169146919_169154561_FR | OBD159_2933 | GGTTGGGCAGACAGTTCCTGGGA (SEQ ID NO: 3422) |
| 182 ORF17_9_94818790_94822742_94893440_94896165_FF | OBD159_2937 | TCATCTCAGTTGCTTTCTGCTGGAGC (SEQ ID NO: 3423) |
| 183 ORF17_X_1174946_1177246_1240440_1242375_RF | OBD159_2941 | CGCCTGTAATCCCAGCAGTTTGG (SEQ ID NO: 3424) |
| 184 ORF17_X_5594024_5600926_5621246_5623679_FR | OBD159 2945 | GAGACATTGGCTGTGGGTTTGTT (SEQ ID NO: 3425) |
| 185 ORF170_3_106246431 106249672_106313861_106318469_FR | OBD159_2949 | CATCATTTCCCGCCCTTGTCTTTA (SEQ ID NO: 3426) |

TABLE 4.b7-continued

| Probe | PCR-Primer1_ID | PCR_Primer1 |
|---|---|---|
| 186 ORF170_6_157307294_157314514_157337743_157340036_RF | OBD159_2953 | GGCGGTTTGGAGGTTGGGCAGTT (SEQ ID NO: 3427) |
| 187 ORF170_8_113381107_113383608_113436243_113437347_RR | OBD159_2957 | GCAGAACCCCTTGTAATCCCCAAATA (SEQ ID NO: 3428) |
| 188 ORF171_12_26016038_26021057_26034684_26036629_FR | OBD159_2961 | TTTCTAAGCACTCAGGGCAATGTCTA (SEQ ID NO: 3429) |
| 189 ORF172_2_129205308_129208404_129231919_129233302_RF | OBD159_2965 | GAGGCGAATAGGACCCAGGTAGAA GT (SEQ ID NO: 3430) |
| 190 ORF172_9_33252746_33260644_33317596_33319558_FR | OBD159_2969 | GGTTGCTGACCTCATCTGTCTTT (SEQ ID NO: 3431) |
| 191 ORF173_12_96219857_96223649_96237099_96241349_RF | OBD159_2973 | GCCTGTGGCTTTATGCCTGGGTC (SEQ ID NO: 3432) |
| 192 ORF173_8_97885717_97888667_97943674_97946241_FF | OBD159_2977 | TGTTGTTGGACCTATCTGAGCAAAG G (SEQ ID NO: 3406) |
| 193 ORF176_2_209659511_209662054_209735707_209738646_FF | OBD159_2981 | GGTATTGCCAGCCACAGCGTTTGATA (SEQ ID NO: 3434) |
| 194 ORF176_6_61648546_61654260_61698546_61699905_RF | OBD159_2985 | GCTCAGCCCTCACTGCCCAACAT (SEQ ID NO: 3435) |
| 195 ORF177_2_21342478_21344227_21387178_21390560_RF | OBD159_2989 | ACTGAAGTATTACAGGAGTGATGGG (SEQ ID NO: 3436) |
| 196 ORF177_3_78739183_78745105_78757303_78759810_FF | OBD159_2993 | TCAATCCCACCTGAACCCTAATGAAT (SEQ ID NO: 3437) |
| 197 ORF177_8_97811124_97813316_97885717_97888667_RF | OBD159_2997 | GGTCCTTGTTGGATGTGCTGGGC (SEQ ID NO: 3415) |
| 198 ORF179_2_195583610_195589061_195630259_195633750_FR | OBD159_3001 | GGCTATTGGAATGGCTGAAGTGTGA A (SEQ ID NO: 3439) |
| 199 ORF18_1_110155952_110164041_110268937_110272034_FF | OBD159_3005 | AGAGATGCCCTTCCTGACTGCCC (SEQ ID NO: 3369) |
| 200 ORF18_12_83891421_83896037_83954032_83957600_FF | OBD159_3009 | TGTGACGGTGCCTGCTTCCCCTT (SEQ ID NO: 3441) |
| 201 ORF18_2_11504797_11509096_11532162_11535545_RF | OBD159_3013 | CTTTTGAAGGTCATCTCAGGAAGGG C (SEQ ID NO: 3442) |
| 202 ORF18_2_20297935_20303337_20328998_20331608_RR | OBD159_3017 | GCTCTCACATTTATTTTATGCCAGTC (SEQ ID NO: 3443) |
| 203 ORF18_21_17391129_17392895_17437778_17439433_FF | OBD159_2257 | CGCCTGTAATCCCACCACTTTGG (SEQ ID NO: 3008) |
| 204 ORF18_4_153693586_153700349_153764783_153769098_FF | OBD159_3021 | CCCAAACGCTTTCCACCAGGTCC (SEQ ID NO: 3445) |
| 205 ORF18_6_134212503_134214388_134270140_134271366_RF | OBD159_2761 | GGCAGGAGAATCACTTGAACCTA (SEQ ID NO: 3377) |
| 206 ORF18_6_162152986_162154134_162206360_162211749_RF | OBD159_3025 | CTCCCACATTCTTTGTTCATCTTCAA (SEQ ID NO: 3447) |
| 207 ORF18_X_37313041_37321250_37333766_37337668_FR | OBD159_3029 | CCTATCTGGCTGTGACACCTGCTGAT (SEQ ID NO: 3448) |
| 208 ORF180_2_56308065_56316578_56390760_56394124_FF | OBD159_3033 | GTCTGAGGACCCACACAAAGGAACT T (SEQ ID NO: 3449) |
| 209 ORF183_22_20770086_20774393_20816159_20817209_FR | OBD159_3037 | GTTCCATTGTTGGGAGAGTTGAC (SEQ ID NO: 3450) |
| 210 ORF183_8_9123942_9126289_9220259_9225462_FR | OBD159_3041 | CAGCAACCTCTTCTGGTCTTTGA (SEQ ID NO: 3451) |
| 211 ORF184_1_211433313_211435632_211464001_211470782_RF | OBD159_3045 | ATCCCAGCATTTTGGAAGACTGAG |

TABLE 4.b7-continued

| Probe | PCR-Primer1_ID | PCR_Primer1 |
|---|---|---|
| | | (SEQ ID NO: 3452) |
| 212 ORF184_10_89827266_89829504_89863078_89864649_RF | OBD159_3049 | CCCACTGGAGCATAAGATGAACCAAT (SEQ ID NO: 3397) |
| 213 ORF184_11_75861382_75864724_75932505_75943225_FF | OBD159_3053 | GCCTCTGAAGAAGCACTGCCAGG (SEQ ID NO: 3454) |
| 214 ORF184_5_167857386_167858550_167921706_167923030_FR | OBD159_3057 | GGTTGGTAGTGGCTTCTTTCCTGGCA (SEQ ID NO: 3455) |
| 215 ORF185_17_16799136_16800747_16881471_16884846_FF | OBD159_3061 | ATGGAGCGAGGTATGGTGGCATTGC (SEQ ID NO: 3456) |
| 216 ORF186_6_73688989_73690148_73742434_73750026_FF | OBD159_3065 | TCAGTGTTTGCTTTTCCCTTGAAT (SEQ ID NO: 718) |
| 217 ORF187_6_151443530_151449164 151537463_151538576_FF | OBD159_3069 | CGCCTGTAACCCCAGCATTTTGG (SEQ ID NO: 940) |
| 218 ORF189_1_48532003_48539768_48603267_48618802_FR | OBD159_3073 | AAGGTTCTTGCCACATTCCGCCC (SEQ ID NO: 3459) |
| 219 ORF19_1_110141802_110145853_110155952_110164041_RF | OBD159_2281 | GCATAAAAGAGCCACCTGCCAGC (SEQ ID NO: 3015) |
| 220 ORF19_1_223787115_223791224_223834661_223838535_RR | OBD159_3077 | CAAAGTGCTGAAGTTATGGGCGT (SEQ ID NO: 3461) |
| 221 ORF19_12_13270343_13274324_13311794_13314398_RF | OBD159_3081 | TAGGGTGGGCACAGAAGGGTGGT (SEQ ID NO: 3373) |
| 222 ORF19_15_22839534_22840551_22879924_22886427_RF | OBD159_3085 | GCAGATAGCAGGAGACCCCTACTG (SEQ ID NO: 3463) |
| 223 ORF19_18_12837148_12839042_12851275_12853060_RF | OBD159_3089 | TAAAAGCCATCCCTGCCTCCTTGGG (SEQ ID NO: 3464) |
| 224 ORF19_2_78763526_78765449_78804372_78809080_FR | OBD159_3093 | GATTTCTCAGTTTACATAGTTCAAA (SEQ ID NO: 764) |
| 225 ORF19_21_17391129_17392895_17434190_17435748_FF | OBD159_2253 | CGCCTGTAATCCCACCACTTTGG (SEQ ID NO: 3008) |
| 226 ORF19_5_93562856_93565579_93582366_93583770_FF | OBD159_3097 | ATGCCCAGTCATAGGTGATAAGATTA (SEQ ID NO: 742) |
| 227 ORF19_X_115872740_115875445_115936015_115945579_RF | OBD159_3101 | CAGGAATCATTTGACACAATCCCC (SEQ ID NO: 260) |
| 228 ORF190 1 48532003 48539768 48603267 48618802_FF | OBD159_3105 | TTCTTGCCACATTCCGCCCCAGC (SEQ ID NO: 3047) |
| 229 ORF190_17_36192362_36195269_36216401_36221747_RR | OBD159_3109 | CCCTTCTAATGTCCATAGGCTAC (SEQ ID NO: 3470) |
| 230 ORF190_4_175635137_175638077_175657671_175665421_RF | OBD159_3113 | CCGAGGGATAGGGATTCTGTTTTGTT (SEQ ID NO: 3471) |
| 231 ORF190_8_97885717_97888667_97911504_97913312_FF | OBD159_3117 | TGTTGTTGGACCTATCTGAGCAAAG (SEQ ID NO: 3406) |
| 232 ORF191_19_46459835_46460902_46479838_46481514_RF | OBD159_3121 | CAGTCTTGGCTGGTGATGATTCCTGA (SEQ ID NO: 440) |
| 233 ORF191_9_28333777 28339631_28374860_28379516_FF | OBD159_3125 | GCCTAAGTCCAGTAGTATGGTGGCTG (SEQ ID NO: 1204) |
| 234 ORF194_4_15556941_15559956_15665131_15667839_RR | OBD159_3129 | GGAGAGATTTGTGCCAGACTACAGTG (SEQ ID NO: 3475) |
| 235 ORF195_8_97885717_97888667_97955459_97960176_FR | OBD159_3133 | TGTTGTTGGACCTATCTGAGCAAAG (SEQ ID NO: 3406) |
| 236 ORF197_9_33260644_33262136_33317596_33319558_RR | OBD159_3137 | GTTCCAGTTCAGGAGCCTCTCTC (SEQ ID NO: 3477) |

TABLE 4.b7-continued

| | Probe | PCR-Primer1_ID | PCR_Primer1 |
|---|---|---|---|
| 237 | ORF197_X_101076588_101078760_101106636_101109429_FF | OBD159_3141 | CATAACCTCCCTTCTCCCCATTT (SEQ ID NO: 3478) |
| 238 | ORF198 13_45792577_45800189_45859224_45860475_RR | OBD159_3145 | GCAGCATTCCTGTATGTGGTTTGACT (SEQ ID NO: 3479) |
| 239 | ORF198_14_73418771_73426644_73454993_73457655_RR | OBD159_3149 | AAGGAAGAAGAGTCACCATAGGAC (SEQ ID NO: 3480) |
| 240 | ORF198_2_164430286_164435469_164495161_164496648_FF | OBD159_3153 | GGTGTGTGTTTATGTGTGACTATTTG (SEQ ID NO: 3481) |

TABLE 4.B8

| | PCR-Primer2_ID | PCR_Primer2 | Marker | GLMNET |
|---|---|---|---|---|
| 121 | OBD159_2703 | GAACTGGAGGAGGGTGGATAGGG (SEQ ID NO: 3482) | OBD159_2701_2703 | -0.005199586 |
| 122 | OBD159_2707 | GGTTCTAAAGTTCCATTTGGTTCTCC (SEQ ID NO: 3483) | OBD159_2705_2707 | -0.00386514 |
| 123 | OBD159_2711 | GACACCTGGCAGCAGTCATTTACAGT (SEQ ID NO: 3484) | OBD159_2709_2711 | -0.000800747 |
| 124 | OBD159_2715 | TTCTTCAATGGCTCCTGATGCTTAGC (SEQ ID NO: 3485) | OBD159_2713_2715 | -0.003111828 |
| 125 | OBD159_2719 | TCCTTTCCTGAGAGAGTAGGGATA (SEQ ID NO: 3172) | OBD159_2717_2719 | 0 |
| 126 | OBD159_2723 | CTTTTACTTCAGGGACCCCAGGTGTC (SEQ ID NO: 954) | OBD159_2721_2723 | -0.000781517 |
| 127 | OBD159_2727 | TTATTCTACCCTTCCTGCCCTGCCCT (SEQ ID NO: 3488) | OBD159_2725_2727 | -0.005003739 |
| 128 | OBD159_2731 | GTTCGGCTTGATGGCAGAGACTC (SEQ ID NO: 3489) | OBD159_2729_2731 | -0.004794101 |
| 129 | OBD159_2735 | AGACTGTGATTCCCAGGGCAGGA (SEQ ID NO: 3490) | OBD159_2733_2735 | -0.00222434 |
| 130 | OBD159_2739 | CTCAAAGCCATCTCCTGGTAGGG (SEQ ID NO: 3491) | OBD159_2737_2739 | -0.003039333 |
| 131 | OBD159_2743 | CTGGGACTACTTAGGTATGAGCCACC (SEQ ID NO: 3492) | OBD159_2741_2743 | -0.002011716 |
| 132 | OBD159_2747 | GGGAAAGAGCAACAGGAGACACC (SEQ ID NO: 3493) | OBD159_2745_2747 | -0.001455236 |
| 133 | OBD159_2751 | CATAAACTCCTACCAACTAAGAAT (SEQ ID NO: 254) | OBD159_2749_2751 | -0.001882457 |
| 134 | OBD159_2755 | TTTCTACAGATACGCACCCACACAGA (SEQ ID NO: 3495) | OBD159_2753_2755 | -0.001287372 |
| 135 | OBD159_2759 | TCAGGCTTGGGCTCTGTAATGGAG (SEQ ID NO: 3496) | OBD159_2757_2759 | -0.001564398 |
| 136 | OBD159_2763 | TACTGGAAAGGATGTCTTCTGGG (SEQ ID NO: 3497) | OBD159_2761_2763 | -0.002351873 |
| 137 | OBD159_2767 | GACTGTTTTCAGAGACAATGGAAT (SEQ ID NO: 3498) | OBD159_2765_2767 | -0.001384665 |
| 138 | OBD159_2771 | TCCCTGTAATCCCAGCATTTTGG (SEQ ID NO: 3499) | OBD159_2769_2771 | -0.000490727 |
| 139 | OBD159_2775 | CTCCACTTCTACCACCACGAGTA (SEQ ID NO: 320) | OBD159_2773_2775 | -0.001637816 |
| 140 | OBD159_2779 | AAGAGACAGACAGGCTGGGCGTG (SEQ | OBD159_2777_2779 | -0.001512532 |

TABLE 4.B8-continued

| | PCR-Primer2_ID | PCR_Primer2 | Marker | GLMNET |
|---|---|---|---|---|
| | | ID NO: 3501) | | |
| 141 | OBD159_2783 | GCATTCGGTTATCTGTTTGCTTACTT (SEQ ID NO: 3502) | OBD159_2781_2783 | -0.001942432 |
| 142 | OBD159_2787 | TGGAAACTGGGAGAGGAGACAGC (SEQ ID NO: 3503) | OBD159_2785_2787 | -0.000541437 |
| 143 | OBD159_2791 | TCATCGTCAGACCCAAGATACTTTTG (SEQ ID NO: 3504) | OBD159_2789_2791 | -0.000989294 |
| 144 | OBD159_2795 | GTGGGAAAGGATGGAGAGTTGGATGA (SEQ ID NO: 3505) | OBD159_2793_2795 | -0.000474951 |
| 145 | OBD159_2799 | CAGGTTGTGTGTGGGAGTAGAAAGTC (SEQ ID NO: 3506) | OBD159_2797_2799 | -0.000312322 |
| 146 | OBD159_2803 | TACTAAGAGGTAGAGTGAGACAGC (SEQ ID NO: 3507) | OBD159_2801_2803 | -0.001333616 |
| 147 | OBD159_2807 | CCTTTATCTTCCCTACCCCATCAT (SEQ ID NO: 3508) | OBD159_2805_2807 | -0.00268597 |
| 148 | OBD159_2811 | CCTGTCTCAGCCTCCCAAGTAGC (SEQ ID NO: 3509) | OBD159_2809_2811 | -0.002796481 |
| 149 | OBD159_2815 | CGGCTTCAGGCATACACACAC (SEQ ID NO: 3510) | OBD159_2813_2815 | -0.003896386 |
| 150 | OBD159_2819 | CCTTCTGGGACACTGCCCCTGTG (SEQ ID NO: 3511) | OBD159_2817_2819 | -0.002180365 |
| 151 | OBD159_2823 | AGAGGCACCAGATGCGGAGGAAG (SEQ ID NO: 3512) | OBD159_2821_2823 | -0.000683876 |
| 152 | OBD159_2827 | GTGTATGTAACTGAACAAAGTGAGTC (SEQ ID NO: 3513) | OBD159_2825_2827 | -0.005220708 |
| 153 | OBD159_2831 | GACTACATTTCTCATTTTACTGAA (SEQ ID NO: 3514) | OBD159_2829_2831 | -0.002177987 |
| 154 | OBD159_2835 | GGACTACAGGCGTGAGCCACCAC (SEQ ID NO: 616) | OBD159_2833_2835 | -0.003736644 |
| 155 | OBD159_2839 | GACAGAGACTTGTAGATTGGTTCAAA (SEQ ID NO: 3516) | OBD159_2837_2839 | -0.001662501 |
| 156 | OBD159_2843 | GACCCATTCTATCCCCTCTACTCTGC (SEQ ID NO: 3517) | OBD159_2841_2843 | 0.00026099 |
| 157 | OBD159_2847 | AATGTAAATGTTCTAATGGACACA (SEQ ID NO: 3518) | OBD159_2845_2847 | -0.000527032 |
| 158 | OBD159_2851 | GGATGAGCCTGTGGTCCCTTAGG (SEQ ID NO: 3519) | OBD159_2849_2851 | -0.003482728 |
| 159 | OBD159_2855 | TAATGACCTCCAGCCCCATCCAT (SEQ ID NO: 3520) | OBD159_2853_2855 | -0.001948276 |
| 160 | OBD159_2859 | GCGAGTGTGATGAGGTTTGCTTTATG (SEQ ID NO: 3521) | OBD159_2857_2859 | -0.002278956 |
| 161 | OBD159_2863 | CCACTTGCTACCTGTGTGATACTGAC (SEQ ID NO: 3522) | OBD159_2861_2863 | -0.001062091 |
| 162 | OBD159_2867 | CTTTCACTAATGTGTGGTCTGTGGCA (SEQ ID NO: 3523) | OBD159_2865_2867 | -0.004588914 |
| 163 | OBD159_2871 | TTCCCTGCCTTCCTACTCTTCTTGGG (SEQ ID NO: 3524) | OBD159_2869_2871 | -0.000586293 |
| 164 | OBD159_2875 | GGAGCCCTTGGTCTTGTAATCTGAGC (SEQ ID NO: 3525) | OBD159_2873_2875 | -0.004296281 |
| 165 | OBD159_2879 | CTGGAGTGAGAAGGAAGGGCAGTTTC (SEQ ID NO: 3526) | OBD159_2877_2879 | -0.000700999 |
| 166 | OBD159_2883 | GGAATCCCCTCCTGTGTGCCAGC (SEQ ID NO: 3881) | OBD159_2881_2883 | -0.003629345 |

TABLE 4.B8-continued

| PCR-Primer2_ID | PCR_Primer2 | Marker | GLMNET |
|---|---|---|---|
| | NO: 3527) | | |
| 167 OBD159_2887 | CGAGTAGGATGAGAAGGGCACCC (SEQ ID NO: 3528) | OBD159_2885_2887 | -0.002670683 |
| 168 OBD159_2891 | GTGCTGTTTGCCAACTGGTATGGGAC (SEQ ID NO: 3529) | OBD159_2889_2891 | -0.006025308 |
| 169 OBD159_2895 | ATCAGTGTTTTCTCCTCTCAAATA (SEQ ID NO: 1307) | OBD159_2893_2895 | -0.002350922 |
| 170 OBD159_2899 | TTTCCCTACTTTCTTGCTGTGTGACC (SEQ ID NO: 3531) | OBD159_2897_2899 | -0.002421424 |
| 171 OBD159_2903 | GGACATAAGCCCAAACAGGAACACTG (SEQ ID NO: 1880) | OBD159_2901_2903 | -0.003189291 |
| 172 OBD159_2907 | TTTGAGGTGAGTCTGGCTAAACACAG (SEQ ID NO: 3533) | OBD159_2905_2907 | -0.000912764 |
| 173 OBD159_2911 | CTATTTGGATTGTTGAAAGCCTTGGT (SEQ ID NO: 3534) | OBD159_2909_2911 | -0.001621343 |
| 174 OBD159_2915 | GCCTTGCCAGAAAGCACACAGAG (SEQ ID NO: 3535) | OBD159_2913_2915 | -0.000839095 |
| 175 OBD159_2643 | TACGGAAGATGGAAGTGAGGTGC (SEQ ID NO: 3226) | OBD159_2641_2643 | -0.004245992 |
| 176 OBD159_2919 | GACAAGAGTCCTATCTGGGCTCC (SEQ ID NO: 3537) | OBD159_2917_2919 | -0.003670895 |
| 177 OBD159_2923 | AGAGCAGCAAATCCGTGACTGGG (SEQ ID NO: 3538) | OBD159_2921_2923 | -0.002626094 |
| 178 OBD159_2924 | AGAGCAGCAAATCCGTGACTGGG (SEQ ID NO: 3538) | OBD159_2922_2924 | -0.004391165 |
| 179 OBD159_2925 | AGAGCAGCAAATCCGTGACTGGG (SEQ ID NO: 3538) | OBD159_2923_2925 | -0.002337738 |
| 180 OBD159_2827 | GTGTATGTAACTGAACAAAGTGAGTC (SEQ ID NO: 3513) | OBD159_2825_2827 | -0.004038653 |
| 181 OBD159_2935 | CCTGTGCTCTGCTGTAGTGGAGA (SEQ ID NO: 3542) | OBD159_2933_2935 | -0.002474537 |
| 182 OBD159_2939 | GAAATGAGTAGTTGTGACAGAGGTTG (SEQ ID NO: 3543) | OBD159_2937_2939 | -0.002696675 |
| 183 OBD159_2943 | CTAATCAATCTCACGCTGCTACATAA (SEQ ID NO: 3544) | OBD159_2941_2943 | -0.004107571 |
| 184 OBD159_2947 | ATGCCTTTTCTGATGTTCTGCTGATA (SEQ ID NO: 3545) | OBD159_2945_2947 | -0.005210227 |
| 185 OBD159_2951 | AGAAGTGAAAGAGCAATGAAAATG (SEQ ID NO: 3546) | OBD159_2949_2951 | -0.002750521 |
| 186 OBD159_2955 | CGTGCGACAAGGACTGGGACAAA (SEQ ID NO: 3547) | OBD159_2953_2955 | -0.004135271 |
| 187 OBD159_2959 | TAGGGCTTGAGGCTTTGGGTGGAATA (SEQ ID NO: 3548) | OBD159_2957_2959 | 0 |
| 188 OBD159_2963 | CCCACCCTTGTTTGATTTCCCCTCAT (SEQ ID NO: 3549) | OBD159_2961_2963 | -0.003123212 |
| 189 OBD159_2967 | GTAGACTGAGTAACTTGTAAAGCCTC (SEQ ID NO: 3550) | OBD159_2965_2967 | -0.002403132 |
| 190 OBD159_2971 | GGACTACAGGCGTGAGCCACCAC (SEQ ID NO: 616) | OBD159_2969_2971 | -0.003087019 |
| 191 OBD159_2975 | ATCATCAGAGGATTACTCAGAGGG (SEQ ID NO: 2450) | OBD159_2973_2975 | -0.001260663 |
| 192 OBD159_2979 | GTCTCTTCACTGTCCAGGTAACCCTC (SEQ | OBD159_2977_2979 | -0.00070886 |

TABLE 4.B8-continued

| | PCR-Primer2_ID | PCR_Primer2 | Marker | GLMNET |
|---|---|---|---|---|
| | | ID NO: 3553) | | |
| 193 | OBD159_2983 | GCTGAAGACTTGGTCAAACCTATGGC (SEQ ID NO: 2522) | OBD159_2981_2983 | -0.003981238 |
| 194 | OBD159_2987 | CCTCCCCAGTCAGGATGGTTAGA (SEQ ID NO: 3555) | OBD159_2985_2987 | -0.000151475 |
| 195 | OBD159_2991 | AAGGCACCCAGGTTGGAAAAGAAAA (SEQ ID NO: 3556) | OBD159_2989_2991 | -0.003726158 |
| 196 | OBD159_2995 | GCTGCCCCAGAGGTCTTCACATC (SEQ ID NO: 3557) | OBD159_2993_2995 | -0.003699263 |
| 197 | OBD159_2999 | GGCGTGATTTACATTCCCAGCCG (SEQ ID NO: 3558) | OBD159_2997_2999 | -0.00081063 |
| 198 | OBD159_3003 | CCACCATCCCTCACCCTACACATCTT (SEQ ID NO: 3559) | OBD159_3001_3003 | -0.001691504 |
| 199 | OBD159_3007 | GCATCTGAAAGAGGAGGAGGAGG (SEQ ID NO: 3560) | OBD159_3005_3007 | -0.004612101 |
| 200 | OBD159_3011 | GGAAACTGAAACCGTAACAAGGAACA (SEQ ID NO: 3561) | OBD159_3009_3011 | -0.003361251 |
| 201 | OBD159_3015 | GTCTGGCACAAGAAAGGGCTCAATGA (SEQ ID NO: 3562) | OBD159_3013_3015 | -0.001803071 |
| 202 | OBD159_3019 | TGAGTTGCTGGGACCACAGGCAT (SEQ ID NO: 3563) | OBD159_3017_3019 | -0.001642618 |
| 203 | OBD159_2259 | AAGGATTGCTTGAGCCCAGGAAT (SEQ ID NO: 3129) | OBD159_2257_2259 | -0.003723422 |
| 204 | OBD159_3023 | GACACCTCCAGGCTACACAGACA (SEQ ID NO: 3565) | OBD159_3021_3023 | -0.003729313 |
| 205 | OBD159_2763 | TACTGGAAAGGATGTCTTCTGGG (SEQ ID NO: 3497) | OBD159_2761_2763 | -0.001159911 |
| 206 | OBD159_3027 | GGTGGGCTGAGTAAACGGGACAG (SEQ ID NO: 3567) | OBD159_3025_3027 | -0.001211322 |
| 207 | OBD159_3031 | CAACCCTGCCACGGAAAACAAAACAA (SEQ ID NO: 3568) | OBD159_3029_3031 | -0.001896747 |
| 208 | OBD159_3035 | CTCACTAATGACATCCCACATCGCAG (SEQ ID NO: 850) | OBD159_3033_3035 | -0.003274088 |
| 209 | OBD159_3039 | CACCTGTAATCCCAGCACTTTGG (SEQ ID NO: 3100) | OBD159_3037_3039 | -0.002950916 |
| 210 | OBD159_3043 | GGCAACAGAATGAGACCCTATCT (SEQ ID NO: 3571) | OBD159_3041_3043 | -0.001179682 |
| 211 | OBD159_3047 | GGCTCACACCTGTAATCCCAGCG (SEQ ID NO: 3572) | OBD159_3045_3047 | -0.001995391 |
| 212 | OBD159_3051 | TCCACATCCCACCTTGACCTCTTCCT (SEQ ID NO: 3573) | OBD159_3049_3051 | -0.003219045 |
| 213 | OBD159_3055 | GTCCCACCTCCCAATACTATGGC (SEQ ID NO: 3574) | OBD159_3053_3055 | -0.000934073 |
| 214 | OBD159_3059 | CCTCTCAGCCTTCATCTTTGTATTTG (SEQ ID NO: 3575) | OBD159_3057_3059 | -0.000323198 |
| 215 | OBD159_3063 | GCCCAATGACAGAGCATCAAAACACA (SEQ ID NO: 3576) | OBD159_3061_3063 | -0.004041529 |
| 216 | OBD159_3067 | GAGAGAAACTAAAGTCCAGGAGAC (SEQ ID NO: 3577) | OBD159_3065_3067 | -0.001510221 |
| 217 | OBD159_3071 | CAGCACTTTCCACTTCTAAAATCAGA (SEQ ID NO: 3578) | OBD159_3069_3071 | -0.001925997 |
| 218 | OBD159_3075 | CGGAGTCTTGCTCTGTTGCGAGG (SEQ ID NO: 3073_3075 | OBD159_3073_3075 | -0.003238351 |

TABLE 4.B8-continued

| PCR-Primer2_ID | PCR_Primer2 | Marker | GLMNET |
|---|---|---|---|
| | NO: 3579) | | |
| 219 OBD159_2283 | CCCAAACTCCAAAGGCAGCGTGC (SEQ ID NO: 3135) | OBD159_2281_2283 | -0.004372167 |
| 220 OBD159_3079 | GAGAGAAGTGAGGAAAAGTGGCTA (SEQ ID NO: 3581) | OBD159_3077_3079 | -0.004477186 |
| 221 OBD159_3083 | GACATCCTGCTCCCCATAGTGGA (SEQ ID NO: 3582) | OBD159_3081_3083 | -0.002043805 |
| 222 OBD159_3087 | GGCTGGGAGAGGTTAGAGATGAC (SEQ ID NO: 3583) | OBD159_3085_3087 | -0.002297286 |
| 223 OBD159_3091 | CCAGTTATCGTTTTGTAGGTAGACCA (SEQ ID NO: 3584) | OBD159_3089_3091 | -0.000431389 |
| 224 OBD159_3095 | TGGATTGTTCTTTAGATTTCAGATA (SEQ ID NO: 3585) | OBD159_3093_3095 | -0.002186565 |
| 225 OBD159 2255 | GTCACTTGTGCTAAATGCCACTTC (SEQ ID NO: 3128) | OBD159_2253_2255 | -0.002406363 |
| 226 OBD159_3099 | GAAGCAGAAGAAGGAGCAAGAAAG (SEQ ID NO: 816) | OBD159_3097_3099 | -0.004446875 |
| 227 OBD159_3103 | CTCCACTTCTACCACCACGAGTA (SEQ ID NO: 320) | OBD159_3101_3103 | -0.001580657 |
| 228 OBD159_3107 | GCTATGGCAACAACCTGTGGAGG (SEQ ID NO: 3589) | OBD159_3105_3107 | -0.002607721 |
| 229 OBD159_3111 | CCATCATCGGTTGAATCCACAGAT (SEQ ID NO: 3590) | OBD159_3109_3111 | 0.000618635 |
| 230 OBD159_3115 | GAGGACACATTGGGCAGGAAACATCC (SEQ ID NO: 3591) | OBD159_3113_3115 | -0.002793281 |
| 231 OBD159_3119 | CCATCCACCCCACTTCATCCTTTGTG (SEQ ID NO: 3592) | OBD159_3117_3119 | -0.000906288 |
| 232 OBD159_3123 | CCCTTCAGTGGAACCTTACCCAACAA (SEQ ID NO: 540) | OBD159_3121_3123 | -0.004160869 |
| 233 OBD159_3127 | GTGGTGTGGTTCAAAGAGCACTGTAA (SEQ ID NO: 3594) | OBD159_3125_3127 | -0.00360644 |
| 234 OBD159_3131 | AACAACCCGCCACTGGAACCCTTTTA (SEQ ID NO: 3595) | OBD159_3129_3131 | -0.00408779 |
| 235 OBD159_3135 | GTCTTGGTGTTCCTTACGGTGCCTGT (SEQ ID NO: 3596) | OBD159_3133_3135 | -0.000833178 |
| 236 OBD159_3139 | GGACTACAGGCGTGAGCCACCAC (SEQ ID NO: 616) | OBD159_3137_3139 | -0.002757562 |
| 237 OBD159_3143 | CGCCCAGCCTAATGTGAGATTTT (SEQ ID NO: 3598) | OBD159_3141_3143 | -0.000664345 |
| 238 OBD159_3147 | CTGCCCTCTTCCTTTCCCTCCTGTAT (SEQ ID NO: 1716) | OBD159_3145_3147 | -0.004969047 |
| 239 OBD159_3151 | TTTTATTTTCATTTGGAAGACTGC (SEQ ID NO: 3600) | OBD159_3149_3151 | -0.000603516 |
| 240 OBD159_3155 | AAGGACAATAGGGATGTAAACACACA (SEQ ID NO: 3601) | OBD159_3153_3155 | -0.001805771 |

TABLE 4.b9

| Gene |
|---|
| 121 CCDC85A; rs6747380 |
| 122 BEX4; NXF3 |
| 123 GALNT2; rs4925506 |

TABLE 4.b9-continued

| Gene |
| --- |

124 rs62259232; rs35360328
125 ANKRD55; rs715180
126 PIWIL2; SLC39A14; rs879253763
127 PPM1K; rs6819344; rs7661312; rs2869926; rs881561; rs893971; rs17732955; rs9637599; rs4423843; rs4693210; rs958325; rs13128713; rs6845249; rs34813495; rs7655241; rs28406500; rs10024717; rs4693946; rs7678928; rs13151250; rs28375859; rs11931633; rs9995984; rs10018448; rs1440581; rs1440580; rs17013995; rs17789621; rs7676986; rs7677533; rs7660693; rs6841731; rs1899132; rs28789746; rs9998450; rs4693947; rs28884607; rs6532063; rs1595911; rs1595910; rs1808860; rs1808859; rs28504259; rs1545207; rs10022462; rs17014018; rs4693211; rs4693950; rs12512051
128 KCNC4; SLC6A17; UBL4B; rs775085213; rs375380880
129 PLA2G4A; rs4140564
130 HHAT; rs116161686; rs34585985
131 EMP1; rs1479119
132 EMP1; rs1479119
133 E2F6; GREB1; rs77294520
134 rs10929925; rs16864170
135 GAFA3; PGM2; PTTG2; TBC1D1; rs17578878; rs35859249
136 SGK1; rs1743966; rs1009840; rs4896030; rs9493873
137 TBX18; rs869320679; rs797045022; rs77693245
138 DEPTOR; DSCC1; TAF2
139 PLS3; rs201386833
140 ANKRD6; LYRM2; rs78571182
141 rs111611512
142 ATL2; CYP1B1
143 CDH9; rs201058683
144 LIFR; rs185111230
145 CDH9; rs201058683
146 KIF13B; rs75609241
147 METTL25; TMTC2
148 AC109829.1; FNDC4; GCKR; rs8395; rs2303369; rs704795; rs780090; rs146175795; rs813592; rs1260320; rs149847328; rs2293572; rs2293571; rs1260326; rs3817588; rs4425043; rs6547692; rs780096; rs780095; rs780094; rs780093; rs780092; rs814295; rs11681351; rs704790; rs8179252; rs1260334; rs1260333; rs1313566; rs2950835; rs200826320; rs2911711; rs6753534; rs4665985; rs4665987; rs12473139; rs4665991
149 SNX29; rs12922317
150 rs111611512
151 GALNT2; rs4925506
152 SNX29; rs12922317
153 CD109; SLC17A5
154 CHMP5; NFX1
155 TCEAL7; WBP5
156 KIF20B; rs181778161
157 SGK1; rs9493873
158 rs7015657; rs500816
159 C9orf3; rs7026071
160 IL13RA1; rs3121672; rs2250747
161 CCDC160; PHF6
162 RBM20; rs267607001; rs183007628
163 RAPGEF5; STEAP1B
164 MDGA1; rs9462343
165 MATN2; rs6987225
166 C11orf70; KIAA1377
167 LACRT; PPP1R1A
168 AMIGO2; SLC38A4
169 DPP8; PTPLAD1; VWA9; rs352479; rs9635366; rs352476; rs2456015; rs2456009; rs12916360; rs11632310; rs12906196; rs7165102
170 AMELX; ARHGAP6
171 ADCY2; rs12522444; rs11134242; rs4530734; rs12519539
172 CLIC5; RUNX2
173 GPR125; KCNIP4
174 MATN2; rs6987225
175 SLC6A17; rs375380880; rs775085213
176 KCNC4; SLC6A17; UBL4B; rs775085213; rs375380880
177 LMO3; MGST1; rs10505799
178 OLFM4; rs12552; rs9568797
179 CYFIP1; NIPA1; NIPA2; rs4778334; rs371775791; rs576755299
180 SNX29; rs12922317
181 DHRS9; LRP2; rs80338753; rs202057289; rs80338754; rs764880181; rs4667594; rs786205122; rs2075252
182 C9orf3; rs10993397; rs10761362; rs4385527
183 CRLF2; CSF2RA
184 rs5916200
185 rs12487066
186 TMEM242; ZDHHC14
187 CSMD3; rs189590409
188 RASSF8; rs1546550
189 rs1660895; rs13013037
190 BAG1; CHMP5; NFX1; SPINK4; rs706118; rs3758271
191 ELK3; rs4762284
192 MATN2; rs6987225

TABLE 4.b9-continued

| Gene |
| --- |
| 193 MAP2; rs9288410; rs146432517 |
| 194 AL356135.1; KHDRBS2; rs140996952; rs76014404 |
| 195 rs2337901; rs11897825 |
| 196 ROBO1; rs919603543 |
| 197 LAPTM4B; MATN2; rs6987225 |
| 198 DNAH7; SLC39A10 |
| 199 KCNC4; SLC6A17; UBL4B; rs775085213; rs375380880 |
| 200 rs11116045; rs1545843 |
| 201 E2F6; GREB1; rs77294520 |
| 202 PUM2; rs111612372 |
| 203 CXADR |
| 204 RNF175; TLR2; rs1898830; rs748086774; rs3804099; rs3804100; rs5743704; rs121917864; rs5743708; rs7656411 |
| 205 SGK1; rs1743966; rs1009840; rs4896030; rs9493873 |
| 206 PARK2; rs566229879; rs765648938; rs137853057; rs778798543; rs747984930 |
| 207 FAM47C; PRRG1 |
| 208 CCDC85A; rs186920977; rs6747380; rs17268785 |
| 209 PI4KA; SERPIND1; rs777006911; rs587777759; rs5907; rs142451096; rs121912420; rs587777760 |
| 210 ERI1; PPP1R3B; rs189798; rs9949; rs3748140; rs7011581; rs6998837; rs6999855; rs378974; rs440932; rs365309; rs3748136 |
| 211 RD3; rs11579557 |
| 212 KIF20B; rs181778161 |
| 213 UVRAG; rs7933235 |
| 214 TENM2; rs9647570 |
| 215 CCDC144A; RP11-219A15.1 |
| 216 CD109; SLC17A5 |
| 217 C6orf211; CCDC170; RMND1; rs370863743; rs6933660; rs1971256; rs9479055; rs6931664 |
| 218 AGBL4; SPATA6; rs2803270 |
| 219 SLC6A17; rs775085213 |
| 220 CAPN2; TP53BP2 |
| 221 EMP1; rs1479119 |
| 222 CYFIP1; NIPA2; rs4778334; rs371775791; rs576755299 |
| 223 PTPN2; rs514000; rs11875687; rs657555 |
| 224 REG3G |
| 225 CXADR |
| 226 NR2F1; rs587777277 |
| 227 PLS3; rs201386833 |
| 228 AGBL4; SPATA6; rs2803270 |
| 229 CCL3L3; CCL4L1; TBC1D3B; TBC1D3I |
| 230 GPM6A; rs13144140 |
| 231 LAPTM4B; MATN2 |
| 232 PNMAL1; PNMAL2; PPP5D1 |
| 233 LINGO2; rs7851437 |
| 234 CC2D2A; FBXL5; rs200904521; rs863225178; rs764719093; rs386833748; rs118204053; rs773881370; rs370880399; rs386833749; rs863225173; rs386833750; rs863225169; rs386833751; rs386833752; rs267606709; rs118204051; rs386833753; rs863225170; rs386833754; rs386833755; rs386833756; rs760918829; rs375278294; rs863225171; rs863225172; rs386833757; rs779823379; rs754586025; rs763735590; rs386833758; rs386833759; rs576298659; rs758036385; rs763486732; rs794729225; rs386833760; rs886044295; rs863225176; rs863225168; rs7684446; rs387907058; rs368720062; rs587779732; rs797045437; rs863225179; rs386833762; rs780673487; rs118204052; rs763425007; rs201502401; rs863225174; rs863225175; rs1134634 |
| 235 MATN2; rs6987225 |
| 236 BAG1; CHMP5; NFX1; rs706118; rs3758271 |
| 237 CENPI; TMEM35; TRMT2B |
| 238 SIAH3; rs75061684 |
| 239 HEATR4; NUMB |
| 240 GRB14; rs8192673 |

TABLE 5.a1

| | GeneSet | No_in Gene_Set | In_List | P-value |
| --- | --- | --- | --- | --- |
| 1 | Cadherin signaling pathway(P) | 100 | 7 | 0.000749 |
| 2 | Thyroid hormone synthesis(K) | 74 | 6 | 0.000848 |
| 3 | Glutamatergic synapse(K) | 114 | 7 | 0.00158 |
| 4 | Wnt signaling pathway(P) | 267 | 11 | 0.00209 |
| 5 | 5HT1 type receptor mediated signaling pathway(P) | 19 | 3 | 0.00288 |
| 6 | 5HT4 type receptor mediated signaling pathway(P) | 23 | 3 | 0.00490 |
| 7 | Glycosaminoglycan biosynthesis - heparan sulfate/heparin(K) | 24 | 3 | 0.00551 |
| 8 | Neurexins and neuroligins(R) | 50 | 4 | 0.00658 |
| 9 | ECM-receptor interaction(K) | 82 | 5 | 0.00753 |
| 10 | Beta1 adrenergic receptor signaling pathway(P) | 27 | 3 | 0.00760 |
| 11 | mTOR signaling pathway(K) | 154 | 7 | 0.00803 |
| 12 | GABAergic synapse(K) | 88 | 5 | 0.01 |
| 13 | Morphine addiction(K) | 91 | 5 | 0.0114 |
| 14 | G alpha (12/13) signalling events(R) | 60 | 4 | 0.0122 |

TABLE 5.a1-continued

| GeneSet | No_in Gene_Set | In_List | P-value |
|---|---|---|---|
| 15 CXCR3-mediated signaling events(N) | 35 | 3 | 0.0152 |
| 16 Apelin signaling pathway(K) | 136 | 6 | 0.0157 |
| 17 Long-term potentiation(K) | 67 | 4 | 0.0176 |
| 18 Toll-Like Receptors Cascades(R) | 143 | 6 | 0.0195 |
| 19 Heterotrimeric G-protein signaling pathway-Gi alpha and Gs alpha mediated pathway(P) | 147 | 6 | 0.022 |
| 20 LPA4-mediated signaling events(N) | 16 | 2 | 0.0235 |
| 21 nitric oxide signaling pathway(B) | 17 | 2 | 0.0262 |
| 22 Integrin-linked kinase signaling(N) | 45 | 3 | 0.0291 |
| 23 Toxoplasmosis(K) | 118 | 5 | 0.0308 |
| 24 Clathrin-mediated endocytosis(R) | 118 | 5 | 0.0308 |
| 25 CXCR4-mediated signaling events(N) | 80 | 4 | 0.0309 |
| 26 G alpha (i) signalling events(R) | 345 | 10 | 0.0317 |
| 27 Notch-mediated HES/HEY network(N) | 47 | 3 | 0.0325 |
| 28 Antimicrobial peptides(R) | 47 | 3 | 0.0325 |
| 29 Malaria(K) | 49 | 3 | 0.0361 |
| 30 Beta2 adrenergic receptor signaling pathway(P) | 21 | 2 | 0.0386 |
| 31 Beta3 adrenergic receptor signaling pathway(P) | 21 | 2 | 0.0386 |
| 32 how progesterone initiates the oocyte maturation(B) | 21 | 2 | 0.0386 |
| 33 Oxytocin receptor mediated signaling pathway(P) | 21 | 2 | 0.0386 |
| 34 Small cell lung cancer(K) | 86 | 4 | 0.0386 |
| 35 Amyotrophic lateral sclerosis (ALS)(K) | 51 | 3 | 0.0398 |
| 36 GABA-B_receptor_II_signaling(P) | 3 | 1 | 0.043 |
| 37 Hedgehog 'off' state(R) | 90 | 4 | 0.0444 |
| 38 G alpha (z) signalling events(R) | 23 | 2 | 0.0454 |
| 39 Glutathione metabolism(K) | 54 | 3 | 0.0458 |
| 40 Integration of energy metabolism(R) | 92 | 4 | 0.0474 |
| 41 Endothelin signaling pathway(P) | 55 | 3 | 0.0479 |
| 42 Hypoxia response via HIF activation(P) | 24 | 2 | 0.049 |
| 43 transcription factor creb and its extracellular signals(B) | 24 | 2 | 0.049 |
| 44 Signaling by VEGF(R) | 94 | 4 | 0.0505 |
| 45 Other interleukin signaling(R) | 25 | 2 | 0.0526 |
| 46 C-MYC pathway(N) | 25 | 2 | 0.0526 |
| 47 Cortocotropin releasing factor receptor signaling pathway(P) | 25 | 2 | 0.0526 |
| 48 Circadian entrainment(K) | 96 | 4 | 0.0538 |
| 49 5HT2 type receptor mediated signaling pathway(P) | 26 | 2 | 0.0564 |
| 50 Vasopressin regulates renal water homeostasis via Aquaporins(R) | 26 | 2 | 0.0564 |
| 51 Proteoglycan syndecan-mediated signaling events(N) | 4 | 1 | 0.057 |
| 52 Muscarinic acetylcholine receptor 2 and 4 signaling pathway(P) | 4 | 1 | 0.057 |
| 53 Galactose catabolismr) | 4 | 1 | 0.057 |
| 54 Endocrine resistance(K) | 98 | 4 | 0.0571 |
| 55 Amoebiasis(K) | 98 | 4 | 0.0571 |
| 56 Chemokine signaling pathway(K) | 187 | 6 | 0.0585 |
| 57 Triglyceride metabolism(R) | 27 | 2 | 0.0602 |
| 58 Wnt signaling pathway(K) | 143 | 5 | 0.0606 |
| 59 Estrogen signaling pathway(K) | 100 | 4 | 0.0606 |
| 60 Macroautophagy(R) | 61 | 3 | 0.0614 |
| 61 Retrograde endocannabinoid signaling(K) | 101 | 4 | 0.0624 |
| 62 Arachidonic acid metabolism(K) | 62 | 3 | 0.0638 |
| 63 IL8- and CXCR1-mediated signaling events(N) | 28 | 2 | 0.0642 |
| 64 ErbB4 signaling events(N) | 28 | 2 | 0.0642 |
| 65 Pathways in cancer(K) | 397 | 10 | 0.0685 |
| 66 Longevity regulating pathway - multiple species(K) | 64 | 3 | 0.0688 |
| 67 Adrenergic signaling in cardiomyocytes(K) | 149 | 5 | 0.0695 |
| 68 PI Metabolism(R) | 65 | 3 | 0.0713 |
| 69 Toll-like receptor signaling pathway(K) | 106 | 4 | 0.0717 |
| 70 Pentose phosphate pathway(K) | 30 | 2 | 0.0723 |
| 71 Beta1 integrin cell surface interactions(N) | 66 | 3 | 0.0739 |
| 72 Phagosome(K) | 154 | 5 | 0.0775 |
| 73 DAG and IP3 signaling(R) | 32 | 2 | 0.0808 |
| 74 G-protein beta:gamma signalling(R) | 32 | 2 | 0.0808 |
| 75 Alzheimer disease-presenilin pathway(P) | 111 | 4 | 0.0816 |
| 76 Factors involved in megakaryocyte development and platelet production(R) | 111 | 4 | 0.0816 |
| 77 Proteoglycans in cancer(K) | 205 | 6 | 0.0826 |
| 78 Beta-catenin independent WNT signaling(R) | 112 | 4 | 0.0837 |
| 79 HTLV-I infection(K) | 258 | 7 | 0.0868 |
| 80 Neutrophil degranulation(R) | 418 | 10 | 0.089 |
| 81 IL8- and CXCR2-mediated signaling events(N) | 34 | 2 | 0.0895 |
| 82 Internalization of ErbB1(N) | 35 | 2 | 0.094 |
| 83 Arf6 signaling events(N) | 35 | 2 | 0.094 |
| 84 Class I PI3K signaling events mediated by Akt(N) | 35 | 2 | 0.094 |
| 85 Protein ubiquitination(R) | 74 | 3 | 0.0959 |
| 86 ATR signaling pathway(N) | 37 | 2 | 0.1031 |
| 87 Huntington disease(P) | 122 | 4 | 0.1058 |
| 88 Retinoid metabolism and transport(R) | 38 | 2 | 0.1077 |
| 89 Regulation of RAC1 activity(N) | 38 | 2 | 0.1077 |
| 90 Bacterial invasion of epithelial cells(K) | 78 | 3 | 0.1079 |

TABLE 5.a1-continued

| GeneSet | No_in Gene_Set | In_List | P-value |
|---|---|---|---|
| 91 AMPK signaling pathway(K) | 124 | 4 | 0.1105 |
| 92 Oocyte meiosis(K) | 124 | 4 | 0.1105 |
| 93 Rapid glucocorticoid signaling(N) | 8 | 1 | 0.1107 |
| 94 role of parkin in ubiquitin-proteasomal pathway(B) | 8 | 1 | 0.1107 |
| 95 Signaling events mediated by Hepatocyte Growth Factor Receptor (c-Met)(N) | 80 | 3 | 0.114 |
| 96 FOXM1 transcription factor network(N) | 40 | 2 | 0.1172 |
| 97 Nicotine addiction(K) | 40 | 2 | 0.1172 |
| 98 Axon guidance(K) | 177 | 5 | 0.1203 |
| 99 Aldosterone synthesis and secretion(K) | 82 | 3 | 0.1203 |
| 100 Regulation of mitotic cell cycle(R) | 83 | 3 | 0.1235 |

TABLE 5.a2

| | FDR | Nodes | RatioOfProteinInGeneSet |
|---|---|---|---|
| 1 | 0.2306 | FZD3, FZD9, CTNNA2, PCDHGA3, PCDHGA2, PCDHGA1, PCDH8 | 0.0089 |
| 2 | 0.2306 | ADCY2, SLC26A4, GPX6, GPX5, GPX7, LRP2 | 0.0066 |
| 3 | 0.284 | PPP3R1, GRIN2B, DLGAP1, ADCY2, GRK3, GRM1, GNG2 | 0.0102 |
| 4 | 0.284 | SFRP2, FZD3, FZD9, CTNNA2, MYCN, PPP6C, PCDHGA3, PCDHGA2, PCDHGA1, GNG2, PCDH8 | 0.0239 |
| 5 | 0.3144 | ADCY2, SNAP25, GNG2 | 0.0017 |
| 6 | 0.337 | ADCY2, SNAP25, GNG2 | 0.0021 |
| 7 | 0.337 | NDST4, GLCE, EXTL3 | 0.0021 |
| 8 | 0.337 | GRIN2B, DLGAP1, GRM1, NLGN4X | 0.0045 |
| 9 | 0.337 | SDC1, LAMA4, LAMA3, THBS2, SV2B | 0.0073 |
| 10 | 0.337 | ADCY2, SNAP25, GNG2 | 0.0024 |
| 11 | 0.337 | SKP2, ATP6V1G1, FZD3, FZD9, RICTOR, PIK3CG, MTOR | 0.0138 |
| 12 | 0.337 | GABARAPL1, GABRG2, ADCY2, GNG2, PLCL1 | 0.0079 |
| 13 | 0.337 | GABRG2, ADCY2, GRK3, OPRM1, GNG2 | 0.0081 |
| 14 | 0.337 | TIAM2, RHOB, ARHGEF7, GNG2 | 0.0054 |
| 15 | 0.337 | RICTOR, GNG2, MTOR | 0.0031 |
| 16 | 0.337 | GABARAPL1, MYL3, ADCY2, PIK3CG, GNG2, MTOR | 0.0122 |
| 17 | 0.337 | PPP3R1, GRIN2B, PPP1R1A, GRM1 | 0.006 |
| 18 | 0.337 | RPS6KA5, CTSB, TLR2, TAB2, LBP, BPI | 0.0128 |
| 19 | 0.337 | PRKAR2B, ADCY2, GRK3, GRM1, OPRM1, GNG2 | 0.0131 |
| 20 | 0.337 | RPS6KA5, ADCY2 | 0.0014 |
| 21 | 0.337 | PRKAR2B, GRIN2B | 0.0015 |
| 22 | 0.337 | ARHGEF7, RICTOR, ELMO2 | 0.004 |
| 23 | 0.337 | TLR2, TAB2, PIK3CG, LAMA4, LAMA3 | 0.0105 |
| 24 | 0.337 | SNX9, AMPH, GRK3, SYNJ2, LRP2 | 0.0105 |
| 25 | 0.337 | RHOB, RICTOR, GNG2, MTOR | 0.0072 |
| 26 | 0.337 | PPP3R1, PRKAR2B, SDC1, ADCY2, CXCR6, OPRM1, SLC24A1, LRP2, GNG2, METAP2 | 0.0308 |
| 27 | 0.337 | RUNX2, GATA4, GHR | 0.0042 |
| 28 | 0.337 | TLR2, DCD, BPI | 0.0042 |
| 29 | 0.337 | SDC1, TLR2, THBS2 | 0.0044 |
| 30 | 0.337 | SNAP25, GNG2 | 0.0019 |
| 31 | 0.337 | SNAP25, GNG2 | 0.0019 |
| 32 | 0.337 | PAQR5, PRKAR2B | 0.0019 |
| 33 | 0.337 | SNAP25, GNG2 | 0.0019 |
| 34 | 0.337 | SKP2, PIK3CG, LAMA4, LAMA3 | 0.0077 |
| 35 | 0.337 | PPP3R1, GRIN2B, DERL1 | 0.0046 |
| 36 | 0.337 | ADCY2 | 0.0003 |
| 37 | 0.337 | IFT172, PSMD6, PRKAR2B, NUMB | 0.008 |
| 38 | 0.337 | ADCY2, GNG2 | 0.0021 |
| 39 | 0.337 | GPX6, GPX5, GPX7 | 0.0048 |
| 40 | 0.337 | PRKAR2B, ADCY2, SNAP25, GNG2 | 0.0082 |
| 41 | 0.337 | PRKAR2B, ADCY2, PIK3CG | 0.0049 |
| 42 | 0.337 | PIK3CG, MTOR | 0.0021 |
| 43 | 0.337 | RPS6KA5, PRKAR2B | 0.0021 |
| 44 | 0.337 | CYFIP1, RICTOR, ELMO2, MTOR | 0.0084 |
| 45 | 0.337 | SDC1, SNAP25 | 0.0022 |
| 46 | 0.337 | SKP2, FBXW7 | 0.0022 |
| 47 | 0.337 | SNAP25, GNG2 | 0.0022 |
| 48 | 0.337 | RPS6KA5, GRIN2B, ADCY2, GNG2 | 0.0086 |
| 49 | 0.337 | SNAP25, GNG2 | 0.0023 |
| 50 | 0.337 | PRKAR2B, ADCY2 | 0.0023 |
| 51 | 0.337 | SDC1 | 0.0004 |
| 52 | 0.337 | PRKAR2B | 0.0004 |
| 53 | 0.337 | PGM2 | 0.0004 |
| 54 | 0.337 | ADCY2, ABCB11, PIK3CG, MTOR | 0.0088 |
| 55 | 0.337 | TLR2, PIK3CG, LAMA4, LAMA3 | 0.0088 |
| 56 | 0.337 | XCR1, ADCY2, CXCR6, GRK3, PIK3CG, GNG2 | 0.0167 |

TABLE 5.a2-continued

| | FDR | Nodes | RatioOfProteinInGeneSet |
|---|---|---|---|
| 57 | 0.337 | DGAT2, GPD2 | 0.0024 |
| 58 | 0.337 | SFRP2, PPP3R1, FZD3, FZD9, PRICKLE2 | 0.0128 |
| 59 | 0.337 | ADCY2, PIK3CG, GRM1, OPRM1 | 0.0089 |
| 60 | 0.337 | GABARAPL1, UVRAG, MTOR | 0.0055 |
| 61 | 0.337 | GABRG2, ADCY2, GRM1, GNG2 | 0.009 |
| 62 | 0.337 | GPX6, GPX5, GPX7 | 0.0055 |
| 63 | 0.337 | PIK3CG, GNG2 | 0.0025 |
| 64 | 0.337 | GRIN2B, TAB2 | 0.0025 |
| 65 | 0.337 | SKP2, FZD3, FZD9, ADCY2, CTNNA2, PIK3CG, LAMA4, LAMA3, GNG2, MTOR | 0.0355 |
| 66 | 0.337 | ADCY2, PIK3CG, MTOR | 0.0057 |
| 67 | 0.337 | RPS6KA5, MYL3, PPP1R1A, ADCY2, PIK3CG | 0.0133 |
| 68 | 0.337 | SBF2, SYNJ2, PIK3CG | 0.0058 |
| 69 | 0.337 | TLR2, TAB2, PIK3CG, LBP | 0.0095 |
| 70 | 0.337 | PGM2, FBP1 | 0.0027 |
| 71 | 0.337 | LAMA4, LAMA3, THBS2 | 0.0059 |
| 72 | 0.337 | ATP6V1G1, OLR1, TLR2, TUBB8, THBS2 | 0.0138 |
| 73 | 0.337 | PRKAR2B, ADCY2 | 0.0029 |
| 74 | 0.337 | PIK3CG, GNG2 | 0.0029 |
| 75 | 0.337 | FZD3, FZD9, CTNNA2, LRP2 | 0.0099 |
| 76 | 0.337 | GATA4, PRKAR2B, KIF23, PHF21A | 0.0099 |
| 77 | 0.337 | FZD3, FZD9, SDC1, TLR2, PIK3CG, MTOR | 0.0183 |
| 78 | 0.337 | PSMD6, PPP3R1, FZD3, GNG2 | 0.01 |
| 79 | 0.337 | PPP3R1, FZD3, FZD9, ADCY2, PTTG1, PTTG2, PIK3CG | 0.0231 |
| 80 | 0.337 | CYFIP1, PSMD6, OLR1, CTSB, TLR2, CD59, SNAP25, PGM2, CHI3L1, BPI | 0.0374 |
| 81 | 0.337 | PIK3CG, GNG2 | 0.003 |
| 82 | 0.337 | ARHGEF7, AMPH | 0.0031 |
| 83 | 0.337 | KIF13B, IPCEF1 | 0.0031 |
| 84 | 0.337 | RICTOR, MTOR | 0.0031 |
| 85 | 0.337 | SHPRH, DERL1, UBE2G1 | 0.0066 |
| 86 | 0.337 | NBN, RFC3 | 0.0033 |
| 87 | 0.337 | CYFIP1, GRIN2B, TUBB8, DNAH7 | 0.0109 |
| 88 | 0.337 | SDC1, LRP2 | 0.0034 |
| 89 | 0.337 | TIAM2, ARHGEF7 | 0.0034 |
| 90 | 0.337 | CTNNA2, ELMO2, PIK3CG | 0.007 |
| 91 | 0.337 | PIK3CG, TBC1D1, FBP1, MTOR | 0.0111 |
| 92 | 0.337 | PPP3R1, ADCY2, PTTG1, PTTG2 | 0.0111 |
| 93 | 0.337 | GNG2 | 0.0007 |
| 94 | 0.337 | UBE2G1 | 0.0007 |
| 95 | 0.337 | RIN2, NUMB, MTOR | 0.0072 |
| 96 | 0.337 | SKP2, LAMA4 | 0.0036 |
| 97 | 0.337 | GABRG2, GRIN2B | 0.0036 |
| 98 | 0.337 | PPP3R1, FZD3, EFNB1, PLXNA2, PIK3CG | 0.0158 |
| 99 | 0.337 | ADCY2, NR4A2, CAMK1D | 0.0073 |
| 100 | 0.337 | PSMD6, SKP2, PTTG1 | 0.0074 |

TABLE 5.b1

| | GeneSet | No_in Gene_Set | In_List | P-value |
|---|---|---|---|---|
| 101 | EGFR-dependent Endothelin signaling events(N) | 9 | 1 | 0.1237 |
| 102 | Effects of Botulinum toxin(N) | 9 | 1 | 0.1237 |
| 103 | Pentose phosphate pathway (hexose monophosphate shunt)(R) | 9 | 1 | 0.1237 |
| 104 | Metabotropic glutamate receptor group II pathway(P) | 9 | 1 | 0.1237 |
| 105 | HDR through MMEJ (alt-NHEJ) (R) | 9 | 1 | 0.1237 |
| 106 | Kaposi's sarcoma-associated herpesvirus infection(K) | 180 | 5 | 0.1265 |
| 107 | PI3K-Akt signaling pathway(K) | 341 | 8 | 0.13 |
| 108 | PAR1-mediated thrombin signaling events(N) | 43 | 2 | 0.1318 |
| 109 | LKB1 signaling events(N) | 43 | 2 | 0.1318 |
| 110 | Beta3 integrin cell surface interactions(N) | 43 | 2 | 0.1318 |
| 111 | EPH-Ephrin signaling(R) | 86 | 3 | 0.1333 |
| 112 | FoxO signaling pathway(K) | 134 | 4 | 0.1354 |
| 113 | Hedgehog signaling pathway(P) | 10 | 1 | 0.1364 |
| 114 | Vitamin D metabolism and pathway(P) | 10 | 1 | 0.1364 |
| 115 | 5HT3 type receptor mediated signaling pathway(P) | 10 | 1 | 0.1364 |
| 116 | rho-selective guanine exchange factor akap13 mediates stress fiber formation(B) | 10 | 1 | 0.1364 |
| 117 | il22 soluble receptor signaling pathway(B) | 10 | 1 | 0.1364 |
| 118 | Vitamin D (calciferol) metabolism(R) | 10 | 1 | 0.1364 |
| 119 | Gap junction(K) | 88 | 3 | 0.14 |
| 120 | Fanconi anemia pathway(N) | 45 | 2 | 0.1417 |
| 121 | agrin in postsynaptic differentiation(B) | 45 | 2 | 0.1417 |
| 122 | TNF receptor signaling pathway(N) | 46 | 2 | 0.1467 |

TABLE 5.b1-continued

| GeneSet | No_in Gene_Set | In_List | P-value |
|---|---|---|---|
| 123 C-type lectin receptors (CLRs)(R) | 139 | 4 | 0.1486 |
| 124 Taurine and hypotaurine metabolism(K) | 11 | 1 | 0.149 |
| 125 Mitochondrial iron-sulfur cluster biogenesis(R) | 11 | 1 | 0.149 |
| 126 protein kinase a at the centrosome(B) | 11 | 1 | 0.149 |
| 127 Alpha6 beta4 integrin-ligand interactions(N) | 11 | 1 | 0.149 |
| 128 Class I MHC mediated antigen processing & presentation(R) | 191 | 5 | 0.1507 |
| 129 Insulin signaling pathway(K) | 140 | 4 | 0.1513 |
| 130 Hedgehog signaling pathway(K) | 47 | 2 | 0.1518 |
| 131 Hedgehog signaling events mediated by Gli proteins(N) | 48 | 2 | 0.1569 |
| 132 Amino sugar and nucleotide sugar metabolism(K) | 48 | 2 | 0.1569 |
| 133 Type II diabetes mellitus(K) | 48 | 2 | 0.1569 |
| 134 Neurotransmitter receptors and postsynaptic signal transmission(R) | 143 | 4 | 0.1596 |
| 135 Longevity regulating pathway(K) | 94 | 3 | 0.1606 |
| 136 attenuation of gpcr signaling(B) | 12 | 1 | 0.1614 |
| 137 repression of pain sensation by the transcriptional regulator dream(B) | 12 | 1 | 0.1614 |
| 138 Branched-chain amino acid catabolismr) | 12 | 1 | 0.1614 |
| 139 akap95 role in mitosis and chromosome dynamics(B) | 12 | 1 | 0.1614 |
| 140 phospholipase c-epsilon pathway(B) | 12 | 1 | 0.1614 |
| 141 Signal regulatory protein family interactions(R) | 12 | 1 | 0.1614 |
| 142 GPVI-mediated activation cascade(R) | 49 | 2 | 0.162 |
| 143 Phospholipase D signaling pathway(K) | 144 | 4 | 0.1623 |
| 144 Ovarian steroidogenesis(K) | 50 | 2 | 0.1671 |
| 145 Breast cancer(K) | 146 | 4 | 0.168 |
| 146 Histamine H1 receptor mediated signaling pathway(P) | 13 | 1 | 0.1736 |
| 147 Synaptic_vesicle_trafficking(P) | 13 | 1 | 0.1736 |
| 148 Metabolism of Angiotensinogen to Angiotensins(R) | 13 | 1 | 0.1736 |
| 149 transcription regulation by methyltransferase of carm1(B) | 13 | 1 | 0.1736 |
| 150 Histamine H2 receptor mediated signaling pathway(P) | 13 | 1 | 0.1736 |
| 151 Thyrotropin-releasing hormone receptor signaling pathway(P) | 13 | 1 | 0.1736 |
| 152 Notch signaling pathway(N) | 52 | 2 | 0.1775 |
| 153 Endometrial cancer(K) | 52 | 2 | 0.1775 |
| 154 Translocation of GLUT4 to the plasma membrane(R) | 52 | 2 | 0.1775 |
| 155 ErbB1 downstream signaling(N) | 100 | 3 | 0.1821 |
| 156 Mitotic Telophase/Cytokinesis(R) | 14 | 1 | 0.1857 |
| 157 Melanogenesis(K) | 101 | 3 | 0.1857 |
| 158 Thromboxane A2 receptor signaling(N) | 54 | 2 | 0.188 |
| 159 Cellular senescence(K) | 154 | 4 | 0.1911 |
| 160 Glucagon signaling pathway(K) | 103 | 3 | 0.1931 |
| 161 Transport of inorganic cations/anions and amino acids/oligopeptides(R) | 55 | 2 | 0.1933 |
| 162 Basal cell carcinoma(K) | 55 | 2 | 0.1933 |
| 163 Prolactin receptor signaling(R) | 15 | 1 | 0.1975 |
| 164 Glycosphingolipid biosynthesis - ganglio series(K) | 15 | 1 | 0.1975 |
| 165 PAR4-mediated thrombin signaling events(N) | 15 | 1 | 0.1975 |
| 166 Regulation of lipolysis in adipocytes(K) | 56 | 2 | 0.1986 |
| 167 NCAM signaling for neurite out-growth(R) | 56 | 2 | 0.1986 |
| 168 Jak-STAT signaling pathway(K) | 158 | 4 | 0.203 |
| 169 Acute myeloid leukemia(K) | 57 | 2 | 0.2039 |
| 170 Oxytocin signaling pathway(K) | 159 | 4 | 0.206 |
| 171 Th17 cell differentiation(K) | 107 | 3 | 0.208 |
| 172 Thiamine metabolism(K) | 16 | 1 | 0.2092 |
| 173 akt signaling pathway(B) | 16 | 1 | 0.2092 |
| 174 Heterotrimeric G-protein signaling pathway-Gq alpha and Go alpha mediated pathway(P) | 108 | 3 | 0.2118 |
| 175 TNF signaling pathway(K) | 110 | 3 | 0.2194 |
| 176 Signaling by NOTCH1(R) | 60 | 2 | 0.2199 |
| 177 Syndecan-1-mediated signaling events(N) | 17 | 1 | 0.2207 |
| 178 Thrombin signalling through proteinase activated receptors (PARs) (R) | 17 | 1 | 0.2207 |
| 179 prion pathway(B) | 17 | 1 | 0.2207 |
| 180 Beta5 beta6 beta7 and beta8 integrin cell surface interactions(N) | 17 | 1 | 0.2207 |
| 181 gata3 participate in activating the th2 cytokine genes expression(B) | 17 | 1 | 0.2207 |
| 182 Signal amplification(R) | 17 | 1 | 0.2207 |
| 183 Cholinergic synapse(K) | 111 | 3 | 0.2232 |
| 184 VEGF signaling pathway(K) | 61 | 2 | 0.2253 |
| 185 Signaling by Rho GTPases(R) | 338 | 7 | 0.2289 |
| 186 Metabolic pathways(K) | 1266 | 22 | 0.2296 |
| 187 Neddylation(R) | 223 | 5 | 0.2305 |
| 188 RNA Polymerase II Transcription(R) | 826 | 15 | 0.2311 |
| 189 CGMP-PKG signaling pathway(K) | 168 | 4 | 0.2336 |
| 190 Semaphorin interactions(R) | 63 | 2 | 0.2361 |
| 191 LPA receptor mediated events(N) | 63 | 2 | 0.2361 |
| 192 Synaptic vesicle cycle(K) | 63 | 2 | 0.2361 |
| 193 Ras Pathway(P) | 63 | 2 | 0.2361 |
| 194 IL4-mediated signaling events(N) | 64 | 2 | 0.2415 |
| 195 mTOR signaling pathway(N) | 64 | 2 | 0.2415 |
| 196 Regulation of retinoblastoma protein(N) | 64 | 2 | 0.2415 |
| 197 cystic fibrosis transmembrane conductance regulator (cftr) and beta 2 adrenergic receptor (b2ar) pathway(B) | 19 | 1 | 0.2433 |

TABLE 5.b1-continued

| GeneSet | No_in Gene_Set | In_List | P-value |
|---|---|---|---|
| 198 Inflammatory bowel disease (IBD)(K) | 65 | 2 | 0.2469 |
| 199 Renin secretion(K) | 65 | 2 | 0.2469 |
| 200 Costimulation by the CD28 family(R) | 65 | 2 | 0.2469 |

TABLE 5.b2

| | FDR | Nodes | RatioOfProteinInGeneSet |
|---|---|---|---|
| 101 | 0.337 | MTOR | 0.0008 |
| 102 | 0.337 | SNAP25 | 0.0008 |
| 103 | 0.337 | PGM2 | 0.0008 |
| 104 | 0.337 | PRKAR2B | 0.0008 |
| 105 | 0.337 | NBN | 0.0008 |
| 106 | 0.337 | GABARAPL1, PPP3R1, PIK3CG, GNG2, MTOR | 0.0161 |
| 107 | 0.337 | TLR2, PIK3CG, GHR, LAMA4, LAMA3, THBS2, GNG2, MTOR | 0.0305 |
| 108 | 0.337 | GRK3, GNG2 | 0.0038 |
| 109 | 0.337 | MAP2, MTOR | 0.0038 |
| 110 | 0.337 | SDC1, LAMA4 | 0.0038 |
| 111 | 0.337 | GRIN2B, ARHGEF7, EFNB1 | 0.0077 |
| 112 | 0.337 | SKP2, GABARAPL1, PIK3CG, GRM1 | 0.012 |
| 113 | 0.337 | PRKAR2B | 0.0009 |
| 114 | 0.337 | FDX1 | 0.0009 |
| 115 | 0.337 | SNAP25 | 0.0009 |
| 116 | 0.337 | PRKAR2B | 0.0009 |
| 117 | 0.337 | IL22 | 0.0009 |
| 118 | 0.337 | LRP2 | 0.0009 |
| 119 | 0.337 | ADCY2, TUBB8, GRM1 | 0.0079 |
| 120 | 0.337 | NBN, RFC3 | 0.004 |
| 121 | 0.337 | ARHGEF7, LAMA3 | 0.004 |
| 122 | 0.337 | MAP4K5, TAB2 | 0.0041 |
| 123 | 0.337 | PSMD6, RPS6KA5, PPP3R1, TAB2 | 0.0124 |
| 124 | 0.337 | ADO | 0.001 |
| 125 | 0.337 | FDX1 | 0.001 |
| 126 | 0.337 | PRKAR2B | 0.001 |
| 127 | 0.337 | LAMA3 | 0.001 |
| 128 | 0.337 | PSMD6, SKP2, HERC6, TLR2, FBXW7 | 0.0171 |
| 129 | 0.337 | PRKAR2B, PIK3CG, FBP1, MTOR | 0.0125 |
| 130 | 0.337 | GRK3, LRP2 | 0.0042 |
| 131 | 0.337 | IFT172, GNG2 | 0.0043 |
| 132 | 0.337 | CHIT1, PGM2 | 0.0043 |
| 133 | 0.337 | PIK3CG, MTOR | 0.0043 |
| 134 | 0.337 | GABRG2, GRIN2B, ADCY2, GNG2 | 0.0128 |
| 135 | 0.337 | ADCY2, PIK3CG, MTOR | 0.0084 |
| 136 | 0.337 | PRKAR2B | 0.0011 |
| 137 | 0.337 | PRKAR2B | 0.0011 |
| 138 | 0.337 | PPM1K | 0.0011 |
| 139 | 0.337 | PRKAR2B | 0.0011 |
| 140 | 0.337 | PRKAR2B | 0.0011 |
| 141 | 0.337 | FYB1 | 0.0011 |
| 142 | 0.337 | RHOB, PIK3CG | 0.0044 |
| 143 | 0.337 | ADCY2, PIK3CG, GRM1, MTOR | 0.0129 |
| 144 | 0.337 | GDF9, ADCY2 | 0.0045 |
| 145 | 0.337 | FZD3, FZD9, PIK3CG, MTOR | 0.0131 |
| 146 | 0.337 | GNG2 | 0.0012 |
| 147 | 0.337 | SNAP25 | 0.0012 |
| 148 | 0.337 | AOPEP | 0.0012 |
| 149 | 0.337 | PRKAR2B | 0.0012 |
| 150 | 0.337 | GNG2 | 0.0012 |
| 151 | 0.337 | GNG2 | 0.0012 |
| 152 | 0.337 | SKP2, NUMB | 0.0046 |
| 153 | 0.337 | CTNNA2, PIK3CG | 0.0046 |
| 154 | 0.337 | C2CD5, TBC1D1 | 0.0046 |
| 155 | 0.337 | RPS6KA5, RICTOR, MTOR | 0.0089 |
| 156 | 0.337 | KIF23 | 0.0013 |
| 157 | 0.337 | FZD3, FZD9, ADCY2 | 0.009 |
| 158 | 0.337 | GRK3, GNG2 | 0.0048 |
| 159 | 0.337 | GATA4, PPP3R1, NBN, MTOR | 0.0138 |
| 160 | 0.337 | PPP3R1, ADCY2, FBP1 | 0.0092 |
| 161 | 0.337 | SLC26A4, SLC24A1 | 0.0049 |
| 162 | 0.337 | FZD3, FZD9 | 0.0049 |
| 163 | 0.337 | GHR | 0.0013 |
| 164 | 0.337 | ST6GALNAC3 | 0.0013 |
| 165 | 0.337 | GNG2 | 0.0013 |
| 166 | 0.337 | ADCY2, PIK3CG | 0.005 |

TABLE 5.b2-continued

| | FDR | Nodes | RatioOfProteinInGeneSet |
|---|---|---|---|
| 167 | 0.337 | RPS6KA5, ARTN | 0.005 |
| 168 | 0.337 | IL22, PIK3CG, GHR, MTOR | 0.0141 |
| 169 | 0.337 | PIK3CG, MTOR | 0.0051 |
| 170 | 0.337 | PPP3R1, ADCY2, PIK3CG, CAMK1D | 0.0142 |
| 171 | 0.337 | PPP3R1, IL22, MTOR | 0.0096 |
| 172 | 0.337 | AK5 | 0.0014 |
| 173 | 0.337 | GHR | 0.0014 |
| 174 | 0.337 | GRM1, OPRM1, GNG2 | 0.0097 |
| 175 | 0.337 | RPS6KA5, TAB2, PIK3CG | 0.0098 |
| 176 | 0.337 | FBXW7, NUMB | 0.0054 |
| 177 | 0.337 | SDC1 | 0.0015 |
| 178 | 0.337 | GNG2 | 0.0015 |
| 179 | 0.337 | LAMA3 | 0.0015 |
| 180 | 0.337 | SDC1 | 0.0015 |
| 181 | 0.337 | PRKAR2B | 0.0015 |
| 182 | 0.337 | GNG2 | 0.0015 |
| 183 | 0.337 | ADCY2, PIK3CG, GNG2 | 0.0099 |
| 184 | 0.337 | PPP3R1, PIK3CG | 0.0055 |
| 185 | 0.337 | CYFIP1, TIAM2, SCAI, ARHGAP6, RHOB, ARHGEF7, ARHGAP20 | 0.0302 |
| 186 | 0.337 | NDST4, ATP6V1G1, GLCE, CHIT1, UGT8, FDFT1, ADO, B3GALT1, EXTL3, DHRS9, ETNK1, LARGE2, DGAT2, FOLH1, AK5, SYNJ2, NADK2, PGM2, ST6GALNAC3, FBP1, LAMA3, GALNT2 | 0.1132 |
| 187 | 0.337 | PSMD6, SKP2, PUM2, FBXW7, ASB17 | 0.0199 |
| 188 | 0.337 | PSMD6, SKP2, RUNX2, GATA4, NR2F1, INTS14, MED10, SLU7, RICTOR, NBN, FBXW7, NR4A2, RFC3, MTOR, TAF7 | 0.0738 |
| 189 | 0.337 | GATA4, PPP3R1, ADCY2, PIK3CG | 0.015 |
| 190 | 0.337 | RHOB, PLXNA2 | 0.0056 |
| 191 | 0.337 | ADCY2, GNG2 | 0.0056 |
| 192 | 0.337 | ATP6V1G1, SNAP25 | 0.0056 |
| 193 | 0.337 | RHOB, PIK3CG | 0.0056 |
| 194 | 0.337 | OPRM1, MTOR | 0.0057 |
| 195 | 0.337 | RICTOR, MTOR | 0.0057 |
| 196 | 0.337 | SKP2, RUNX2 | 0.0057 |
| 197 | 0.337 | PRKAR2B | 0.0017 |
| 198 | 0.337 | IL22, TLR2 | 0.0058 |
| 199 | 0.337 | PPP3R1, CTSB | 0.0058 |
| 200 | 0.337 | RICTOR, MTOR | 0.0058 |

TABLE 5.c1

| | GeneSet | No_in Gene_Set | In_List |
|---|---|---|---|
| 201 | Thyroid hormone signaling pathway(K) | 118 | 3 |
| 202 | Glioma(K) | 66 | 2 |
| 203 | Regulation of lipid metabolism by Peroxisome proliferator-activated receptor alpha (PPARalpha)(R) | 119 | 3 |
| 204 | role of brca1 brca2 and atr in cancer susceptibility(B) | 20 | 1 |
| 205 | Steroid biosynthesis(K) | 20 | 1 |
| 206 | regulation of bad phosphorylation(B) | 20 | 1 |
| 207 | Synaptic adhesion-like molecules(R) | 20 | 1 |
| 208 | Central carbon metabolism in cancer(K) | 67 | 2 |
| 209 | Interleukin-17 signaling(R) | 67 | 2 |
| 210 | Glycolysis/Gluconeogenesis(K) | 67 | 2 |
| 211 | Amphetamine addiction(K) | 68 | 2 |
| 212 | Regulation of Telomerase(N) | 68 | 2 |
| 213 | Interleukin-20 family signaling(R) | 21 | 1 |
| 214 | erk1/erk2 mapk signaling pathway(B) | 21 | 1 |
| 215 | growth hormone signaling pathway(B) | 21 | 1 |
| 216 | Cholesterol biosynthesis(R) | 21 | 1 |
| 217 | Notch signaling pathway(P) | 21 | 1 |
| 218 | regulation of ck1/cdk5 by type 1 glutamate receptors(B) | 21 | 1 |
| 219 | TCR signaling(R) | 123 | 3 |
| 220 | Lysosome(K) | 123 | 3 |
| 221 | Cell cycle(K) | 124 | 3 |
| 222 | CDC42 signaling events(N) | 70 | 2 |
| 223 | stathmin and breast cancer resistance to antimicrotubule agents(B) | 22 | 1 |
| 224 | signaling pathway from g-protein families(B) | 22 | 1 |
| 225 | Incretin synthesis, secretion, and inactivation(R) | 22 | 1 |
| 226 | Inositol phosphate metabolism(K) | 71 | 2 |
| 227 | Bile secretion(K) | 71 | 2 |
| 228 | Inflammation mediated by chemokine and cytokine signaling pathway(P) | 72 | 2 |
| 229 | Signaling events mediated by the Hedgehog family(N) | 23 | 1 |
| 230 | Mismatch repair(K) | 23 | 1 |
| 231 | Biosynthesis of unsaturated fatty acids(K) | 23 | 1 |
| 232 | regulation of eif-4e and p70s6 kinase(B) | 23 | 1 |

TABLE 5.c1-continued

| | GeneSet | No_in Gene_Set | In_List |
|---|---|---|---|
| 233 | Visual signal transduction: Rods(N) | 23 | 1 |
| 234 | Mannose type O-glycan biosynthesis(K) | 23 | 1 |
| 235 | Herpes simplex infection(K) | 185 | 4 |
| 236 | B cell receptor signaling pathway(K) | 73 | 2 |
| 237 | Leishmaniasis(K) | 73 | 2 |
| 238 | RAB GEFs exchange GTP for GDP on RABs(R) | 73 | 2 |
| 239 | mtor signaling pathway(B) | 24 | 1 |
| 240 | nfkb activation by nontypeable hemophilus influenzae(B) | 24 | 1 |
| 241 | Myogenesis(R) | 24 | 1 |
| 242 | Ephrin B reverse signaling(N) | 24 | 1 |
| 243 | Growth hormone receptor signaling(R) | 24 | 1 |
| 244 | Vitamin digestion and absorption(K) | 24 | 1 |
| 245 | G alpha (q) signalling events(R) | 188 | 4 |
| 246 | O-linked glycosylation(R) | 75 | 2 |
| 247 | Osteoclast differentiation(K) | 132 | 3 |
| 248 | Validated targets of C-MYC transcriptional activation(N) | 76 | 2 |
| 249 | Glycerophospholipid biosynthesis(R) | 76 | 2 |
| 250 | Fatty acid elongation(K) | 25 | 1 |
| 251 | Nongenotropic Androgen signaling(N) | 25 | 1 |
| 252 | Bile acid and bile salt metabolism(R) | 25 | 1 |
| 253 | Endogenous TLR signaling(N) | 25 | 1 |
| 254 | Huma papillomavirus infection(K) | 313 | 6 |
| 255 | S Phase(R) | 134 | 3 |
| 256 | Glucose metabolism(R) | 78 | 2 |
| 257 | mcalpain and friends in cell motility(B) | 26 | 1 |
| 258 | Apoptosis signaling pathway(P) | 26 | 1 |
| 259 | activation of camp-dependent protein kinase pka(B) | 26 | 1 |
| 260 | Measles(K) | 136 | 3 |
| 261 | Ubiquitin mediated proteolysis(K) | 137 | 3 |
| 262 | DNA Damage/Telomere Stress Induced Senescence(R) | 27 | 1 |
| 263 | Glycosphingolipid biosynthesis - lacto and neolacto series(K) | 27 | 1 |
| 264 | p38 MAPK signaling pathway(N) | 27 | 1 |
| 265 | Glycogen metabolism(R) | 27 | 1 |
| 266 | Collecting duct acid secretion(K) | 27 | 1 |
| 267 | EGFR tyrosine kinase inhibitor resistance(K) | 81 | 2 |
| 268 | Heterotrimeric G-protein signaling pathway-rod outer segment phototransduction(P) | 28 | 1 |
| 269 | Phototransduction(K) | 28 | 1 |
| 270 | Wnt signaling network(N) | 28 | 1 |
| 271 | Reelin signaling pathway(N) | 28 | 1 |
| 272 | Metabolism of steroid hormones(R) | 28 | 1 |
| 273 | adp-ribosylation factor(B) | 28 | 1 |
| 274 | C-MYB transcription factor network(N) | 82 | 2 |
| 275 | L1CAM interactions(R) | 82 | 2 |
| 276 | Hedgehog 'on' state(R) | 82 | 2 |
| 277 | Focal adhesion(K) | 201 | 4 |
| 278 | Signaling pathways regulating pluripotency of stem cells(K) | 142 | 3 |
| 279 | BARD1 signaling events(N) | 29 | 1 |
| 280 | Nicotinate and nicotinamide metabolism(K) | 29 | 1 |
| 281 | Hippo signaling pathway -multiple species(K) | 29 | 1 |
| 282 | Epstein-Barr virus infection(K) | 204 | 4 |
| 283 | HDR through Homologous Recombination (HR) or Single Strand Annealing (SSA)(R) | 85 | 2 |
| 284 | Insulin secretion(K) | 85 | 2 |
| 285 | Regulation of CDC42 activity(N) | 30 | 1 |
| 286 | Cell adhesion molecules (CAMs)(K) | 145 | 3 |
| 287 | Potassium Channels(R) | 87 | 2 |
| 288 | Resolution of Abasic Sites (AP sites)(R) | 31 | 1 |
| 289 | Aurora A signaling(N) | 31 | 1 |
| 290 | Galactose metabolism(K) | 31 | 1 |
| 291 | Striated Muscle Contraction(R) | 31 | 1 |
| 292 | Detoxification of Reactive Oxygen Species(R) | 31 | 1 |
| 293 | Mucin type O-glycan biosynthesis(K) | 31 | 1 |
| 294 | p38 mapk signaling pathway(B) | 31 | 1 |
| 295 | trefoil factors initiate mucosal healing(B) | 31 | 1 |
| 296 | ErbB signaling pathway(K) | 88 | 2 |
| 297 | rho cell motility signaling pathway(B) | 32 | 1 |
| 298 | Syndecan-4-mediated signaling events(N) | 32 | 1 |
| 299 | ROS, RNS production in phagocytes(R) | 32 | 1 |
| 300 | toll-like receptor pathway(B) | 32 | 1 |

TABLE 5.c2

| | P-value | FDR | Nodes | RatioOfProteinInGeneSet |
|---|---|---|---|---|
| 201 | 0.2503 | 0.337 | GATA4, PIK3CG, MTOR | 0.0105 |
| 202 | 0.2523 | 0.337 | PIK3CG, MTOR | 0.0059 |
| 203 | 0.2542 | 0.337 | TIAM2, FDFT1, MED10 | 0.0106 |
| 204 | 0.2543 | 0.337 | NBN | 0.0018 |
| 205 | 0.2543 | 0.337 | FDFT1 | 0.0018 |
| 206 | 0.2543 | 0.337 | PRKAR2B | 0.0018 |
| 207 | 0.2543 | 0.337 | GRIN2B | 0.0018 |
| 208 | 0.2577 | 0.337 | PIK3CG, MTOR | 0.006 |
| 209 | 0.2577 | 0.337 | RPS6KA5, TAB2 | 0.006 |
| 210 | 0.2577 | 0.337 | PGM2, FBP1 | 0.006 |
| 211 | 0.2631 | 0.337 | PPP3R1, GRIN2B | 0.0061 |
| 212 | 0.2631 | 0.337 | NBN, MTOR | 0.0061 |
| 213 | 0.2652 | 0.337 | IL22 | 0.0019 |
| 214 | 0.2652 | 0.337 | RPS6KA5 | 0.0019 |
| 215 | 0.2652 | 0.337 | GHR | 0.0019 |
| 216 | 0.2652 | 0.337 | FDFT1 | 0.0019 |
| 217 | 0.2652 | 0.337 | NUMB | 0.0019 |
| 218 | 0.2652 | 0.337 | PRKAR2B | 0.0019 |
| 219 | 0.2699 | 0.337 | PSMD6, FYB1, TAB2 | 0.011 |
| 220 | 0.2699 | 0.337 | CTSB, SLC17A5, LAPTM4B | 0.011 |
| 221 | 0.2739 | 0.337 | SKP2, PTTG1, PTTG2 | 0.0111 |
| 222 | 0.2739 | 0.337 | ARHGEF7, MTOR | 0.0063 |
| 223 | 0.2759 | 0.337 | PRKAR2B | 0.002 |
| 224 | 0.2759 | 0.337 | PRKAR2B | 0.002 |
| 225 | 0.2759 | 0.337 | GATA4 | 0.002 |
| 226 | 0.2793 | 0.337 | SYNJ2, PIK3CG | 0.0063 |
| 227 | 0.2793 | 0.337 | ADCY2, ABCB11 | 0.0063 |
| 228 | 0.2847 | 0.337 | PIK3CG, PLCL1 | 0.0064 |
| 229 | 0.2865 | 0.337 | LRP2 | 0.0021 |
| 230 | 0.2865 | 0.337 | RFC3 | 0.0021 |
| 231 | 0.2865 | 0.337 | HACD3 | 0.0021 |
| 232 | 0.2865 | 0.337 | GHR | 0.0021 |
| 233 | 0.2865 | 0.337 | SLC24A1 | 0.0021 |
| 234 | 0.2865 | 0.337 | LARGE2 | 0.0021 |
| 235 | 0.288 | 0.337 | SKP2, TLR2, TAB2, NXF3 | 0.0165 |
| 236 | 0.2901 | 0.337 | PPP3R1, PIK3CG | 0.0065 |
| 237 | 0.2901 | 0.337 | TLR2, TAB2 | 0.0065 |
| 238 | 0.2901 | 0.337 | RIN2, SBF2 | 0.0065 |
| 239 | 0.2969 | 0.337 | GHR | 0.0021 |
| 240 | 0.2969 | 0.337 | TLR2 | 0.0021 |
| 241 | 0.2969 | 0.337 | CTNNA2 | 0.0021 |
| 242 | 0.2969 | 0.337 | EFNB1 | 0.0021 |
| 243 | 0.2969 | 0.337 | GHR | 0.0021 |
| 244 | 0.2969 | 0.337 | FOLH1 | 0.0021 |
| 245 | 0.2978 | 0.337 | XCR1, GPR68, GRM1, GNG2 | 0.0168 |
| 246 | 0.3009 | 0.337 | LARGE2, GALNT2 | 0.0067 |
| 247 | 0.3057 | 0.337 | PPP3R1, TAB2, PIK3CG | 0.0118 |
| 248 | 0.3063 | 0.337 | MTDH, NBN | 0.0068 |
| 249 | 0.3063 | 0.337 | DGAT2, GPD2 | 0.0068 |
| 250 | 0.3071 | 0.337 | HACD3 | 0.0022 |
| 251 | 0.3071 | 0.337 | GNG2 | 0.0022 |
| 252 | 0.3071 | 0.337 | ABCB11 | 0.0022 |
| 253 | 0.3071 | 0.337 | TLR2 | 0.0022 |
| 254 | 0.3112 | 0.337 | FZD3, FZD9, LAMA4, LAMA3, THBS2, MTOR | 0.028 |
| 255 | 0.3136 | 0.337 | PSMD6, SKP2, RFC3 | 0.012 |
| 256 | 0.317 | 0.337 | GCKR, FBP1 | 0.007 |
| 257 | 0.3172 | 0.337 | PRKAR2B | 0.0023 |
| 258 | 0.3172 | 0.337 | PIK3CG | 0.0023 |
| 259 | 0.3172 | 0.337 | PRKAR2B | 0.0023 |
| 260 | 0.3216 | 0.337 | TLR2, TAB2, PIK3CG | 0.0122 |
| 261 | 0.3256 | 0.337 | SKP2, UBE2G1, FBXW7 | 0.0122 |
| 262 | 0.3272 | 0.337 | NBN | 0.0024 |
| 263 | 0.3272 | 0.337 | B3GALT1 | 0.0024 |
| 264 | 0.3272 | 0.337 | TAB2 | 0.0024 |
| 265 | 0.3272 | 0.337 | PGM2 | 0.0024 |
| 266 | 0.3272 | 0.337 | ATP6V1G1 | 0.0024 |
| 267 | 0.3331 | 0.337 | PIK3CG, MTOR | 0.0072 |
| 268 | 0.337 | 0.337 | GNG2 | 0.0025 |
| 269 | 0.337 | 0.337 | SLC24A1 | 0.0025 |
| 270 | 0.337 | 0.337 | FZD9 | 0.0025 |
| 271 | 0.337 | 0.337 | GRIN2B | 0.0025 |
| 272 | 0.337 | 0.337 | FDX1 | 0.0025 |
| 273 | 0.337 | 0.337 | ARHGAP6 | 0.0025 |
| 274 | 0.3384 | 0.3384 | CD34, TAB2 | 0.0073 |
| 275 | 0.3384 | 0.3384 | RPS6KA5, NUMB | 0.0073 |
| 276 | 0.3384 | 0.3384 | PSMD6, NUMB | 0.0073 |
| 277 | 0.3407 | 0.3407 | PIK3CG, LAMA4, LAMA3, THBS2 | 0.018 |
| 278 | 0.3456 | 0.3456 | FZD3, FZD9, PIK3CG | 0.0127 |

TABLE 5.c2-continued

| | P-value | FDR | Nodes | RatioOfProteinInGeneSet |
|---|---|---|---|---|
| 279 | 0.3467 | 0.3467 | NBN | 0.0026 |
| 280 | 0.3467 | 0.3467 | NADK2 | 0.0026 |
| 281 | 0.3467 | 0.3467 | FAT4 | 0.0026 |
| 282 | 0.3506 | 0.3506 | PSMD6, SKP2, TAB2, PIK3CG | 0.0182 |
| 283 | 0.3543 | 0.3543 | NBN, RFC3 | 0.0076 |
| 284 | 0.3543 | 0.3543 | ADCY2, SNAP25 | 0.0076 |
| 285 | 0.3562 | 0.3562 | ARHGEF7 | 0.0027 |
| 286 | 0.3575 | 0.3575 | SDC1, CD34, NLGN4X | 0.013 |
| 287 | 0.3648 | 0.3648 | KCNC4, GNG2 | 0.0078 |
| 288 | 0.3656 | 0.3656 | RFC3 | 0.0028 |
| 289 | 0.3656 | 0.3656 | ARHGEF7 | 0.0028 |
| 290 | 0.3656 | 0.3656 | PGM2 | 0.0028 |
| 291 | 0.3656 | 0.3656 | MYL3 | 0.0028 |
| 292 | 0.3656 | 0.3656 | GPX7 | 0.0028 |
| 293 | 0.3656 | 0.3656 | GALNT2 | 0.0028 |
| 294 | 0.3656 | 0.3656 | RPS6KA5 | 0.0028 |
| 295 | 0.3656 | 0.3656 | GHR | 0.0028 |
| 296 | 0.3701 | 0.3701 | PIK3CG, MTOR | 0.0079 |
| 297 | 0.3749 | 0.3749 | ARHGAP6 | 0.0029 |
| 298 | 0.3749 | 0.3749 | LAMA3 | 0.0029 |
| 299 | 0.3749 | 0.3749 | ATP6V1G1 | 0.0029 |
| 300 | 0.3749 | 0.3749 | TLR2 | 0.0029 |

TABLE 5.d1

| | GeneSet | No_in Gene_Set | In_List |
|---|---|---|---|
| 301 | Syndecan-2-mediated signaling events(N) | 32 | 1 |
| 302 | Meiotic recombination(R) | 32 | 1 |
| 303 | Noncanonical Wnt signaling pathway(N) | 32 | 1 |
| 304 | Prostate cancer(K) | 89 | 2 |
| 305 | ABC-family proteins mediated transport(R) | 89 | 2 |
| 306 | Post-translational modification: synthesis of GPI-anchored proteins(R) | 89 | 2 |
| 307 | Rap1 signaling pathway(K) | 212 | 4 |
| 308 | Dilated cardiomyopathy(K) | 90 | 2 |
| 309 | Mitochondrial biogenesis(R) | 90 | 2 |
| 310 | Rheumatoid arthritis(K) | 90 | 2 |
| 311 | Fructose and mannose metabolism(K) | 33 | 1 |
| 312 | Alpha4 beta1 integrin signaling events(N) | 33 | 1 |
| 313 | Trk receptor signaling mediated by the MAPK pathway(N) | 33 | 1 |
| 314 | actions of nitric oxide in the heart(B) | 33 | 1 |
| 315 | Base excision repair(K) | 33 | 1 |
| 316 | Neuroactive ligand-receptor interaction(K) | 278 | 5 |
| 317 | FGF signaling pathway(P) | 92 | 2 |
| 318 | IL1-mediated signaling events(N) | 34 | 1 |
| 319 | ATM pathway(N) | 34 | 1 |
| 320 | Hippo signaling pathway(K) | 154 | 3 |
| 321 | Fc gamma R-mediated phagocytosis(K) | 93 | 2 |
| 322 | IL2 signaling events mediated by PI3K(N) | 35 | 1 |
| 323 | Alanine, aspartate and glutamate metabolism(K) | 35 | 1 |
| 324 | African trypanosomiasis(K) | 35 | 1 |
| 325 | Signaling mediated by p38-alpha and p38-beta(N) | 35 | 1 |
| 326 | NF-kappa B signaling pathway(K) | 95 | 2 |
| 327 | Glycerophospholipid metabolism(K) | 95 | 2 |
| 328 | Integrin signalling pathway(P) | 158 | 3 |
| 329 | Nonhomologous End-Joining (NHEJ)(R) | 36 | 1 |
| 330 | mechanism of gene regulation by peroxisome proliferators via ppara(B) | 36 | 1 |
| 331 | chrebp regulation by carbohydrates and camp(B) | 36 | 1 |
| 332 | DNA replication(K) | 36 | 1 |
| 333 | RET signaling(R) | 36 | 1 |
| 334 | Starch and sucrose metabolism(K) | 36 | 1 |
| 335 | Signalling by NGF(R) | 159 | 3 |
| 336 | Hematopoietic cell lineage(K) | 97 | 2 |
| 337 | Validated transcriptional targets of AP1 family members Fra1 and Fra2(N) | 37 | 1 |
| 338 | rac1 cell motility signaling pathway(B) | 37 | 1 |
| 339 | ErbB2/ErbB3 signaling events(N) | 37 | 1 |
| 340 | Progesterone-mediated oocyte maturation(K) | 98 | 2 |
| 341 | Synthesis of DNA(R) | 98 | 2 |
| 342 | Phosphatidylinositol signaling system(K) | 99 | 2 |
| 343 | Inflammatory mediator regulation of TRP channels(K) | 99 | 2 |
| 344 | TNF signaling(R) | 38 | 1 |
| 345 | Nucleotide-binding domain, leucine rich repeat containing receptor (NLR) signaling pathways(R) | 38 | 1 |
| 346 | Signaling events mediated by HDAC Class II(N) | 38 | 1 |

TABLE 5.d1-continued

| | GeneSet | No_in Gene_Set | In_List |
|---|---|---|---|
| 347 | EPHB forward signaling(N) | 38 | 1 |
| 348 | Telomere Maintenance(R) | 38 | 1 |
| 349 | Aldosterone-regulated sodium reabsorption(K) | 39 | 1 |
| 350 | Choline metabolism in cancer(K) | 101 | 2 |
| 351 | IFN-gamma pathway(N) | 40 | 1 |
| 352 | Aurora B signaling(N) | 40 | 1 |
| 353 | mTOR signalling(R) | 40 | 1 |
| 354 | Neurotransmitter release cycle(R) | 40 | 1 |
| 355 | Class C/3 (Metabotropic glutamate/pheromone receptors)(R) | 40 | 1 |
| 356 | Autophagy(K) | 40 | 1 |
| 357 | HIF-1 signaling pathway(K) | 103 | 2 |
| 358 | Chagas disease (American trypanosomiasis)(K) | 104 | 2 |
| 359 | Intrinsic Pathway for Apoptosis(R) | 41 | 1 |
| 360 | Bladder cancer(K) | 41 | 1 |
| 361 | activation of csk by camp-dependent protein kinase inhibits signaling through the t cell receptor(B) | 41 | 1 |
| 362 | BMP receptor signaling(N) | 41 | 1 |
| 363 | Fat digestion and absorption(K) | 41 | 1 |
| 364 | Signaling by EGFR(R) | 41 | 1 |
| 365 | Homologous recombination(K) | 41 | 1 |
| 366 | NOD-like receptor signaling pathway(K) | 170 | 3 |
| 367 | T cell receptor signaling pathway(K) | 105 | 2 |
| 368 | RNA transport(K) | 171 | 3 |
| 369 | Plasma membrane estrogen receptor signaling(N) | 42 | 1 |
| 370 | Glycosaminoglycan metabolism(R) | 106 | 2 |
| 371 | Cardiac conduction(R) | 107 | 2 |
| 372 | Signaling by ERBB4(R) | 43 | 1 |
| 373 | Purine metabolism(K) | 175 | 3 |
| 374 | Insulin resistance(K) | 109 | 2 |
| 375 | DAP12 interactions(R) | 44 | 1 |
| 376 | Proteasome(K) | 44 | 1 |
| 377 | Interleukin-4 and 13 signaling(R) | 110 | 2 |
| 378 | ABC transporters(K) | 45 | 1 |
| 379 | DNA Double Strand Break Response(R) | 45 | 1 |
| 380 | DNA Damage Bypass(R) | 45 | 1 |
| 381 | RhoA signaling pathway(N) | 45 | 1 |
| 382 | Ether lipid metabolism(K) | 45 | 1 |
| 383 | Validated transcriptional targets of deltaNp63 isoforms(N) | 45 | 1 |
| 384 | Basal transcription factors(K) | 45 | 1 |
| 385 | Cilium Assembly(R) | 179 | 3 |
| 386 | Tuberculosis(K) | 179 | 3 |
| 387 | Carbohydrate digestion and absorption(K) | 46 | 1 |
| 388 | Regulation of RhoA activity(N) | 46 | 1 |
| 389 | FGF signaling pathway(N) | 47 | 1 |
| 390 | Nucleotide excision repair(K) | 47 | 1 |
| 391 | IL6-mediated signaling events(N) | 47 | 1 |
| 392 | Integrins in angiogenesis(N) | 47 | 1 |
| 393 | TGF-beta receptor signaling(N) | 47 | 1 |
| 394 | Sphingolipid metabolism(K) | 47 | 1 |
| 395 | Calcium signaling pathway(K) | 182 | 3 |

TABLE 5.d2

| | P-value | FDR | Nodes | RatioOfProteinInGeneSet |
|---|---|---|---|---|
| 301 | 0.3749 | 0.3749 | LAMA3 | 0.0029 |
| 302 | 0.3749 | 0.3749 | NBN | 0.0029 |
| 303 | 0.3749 | 0.3749 | TAB2 | 0.0029 |
| 304 | 0.3753 | 0.3753 | PIK3CG, MTOR | 0.008 |
| 305 | 0.3753 | 0.3753 | PSMD6, DERL1 | 0.008 |
| 306 | 0.3753 | 0.3753 | CD109, MDGA1 | 0.008 |
| 307 | 0.3772 | 0.3772 | GRIN2B, ADCY2, DOCK4, PIK3CG | 0.019 |
| 308 | 0.3805 | 0.3805 | MYL3, ADCY2 | 0.008 |
| 309 | 0.3805 | 0.3805 | TFB1M, SIRT5 | 0.008 |
| 310 | 0.3805 | 0.3805 | ATP6V1G1, TLR2 | 0.008 |
| 311 | 0.384 | 0.384 | FBP1 | 0.0029 |
| 312 | 0.384 | 0.384 | THBS2 | 0.0029 |
| 313 | 0.384 | 0.384 | RPS6KA5 | 0.0029 |
| 314 | 0.384 | 0.384 | PRKAR2B | 0.0029 |
| 315 | 0.384 | 0.384 | NEIL2 | 0.0029 |
| 316 | 0.3861 | 0.3861 | GABRG2, GRIN2B, GRM1, GHR, OPRM1 | 0.0249 |
| 317 | 0.3908 | 0.3908 | PIK3CG, PPP6C | 0.0082 |
| 318 | 0.393 | 0.393 | TAB2 | 0.003 |
| 319 | 0.393 | 0.393 | NBN | 0.003 |

TABLE 5.d2-continued

| | P-value | FDR | Nodes | RatioOfProteinInGeneSet |
|---|---|---|---|---|
| 320 | 0.3932 | 0.3932 | FZD3, FZD9, CTNNA2 | 0.0138 |
| 321 | 0.396 | 0.396 | AMPH, PIK3CG | 0.0083 |
| 322 | 0.4018 | 0.4018 | MTOR | 0.0031 |
| 323 | 0.4018 | 0.4018 | FOLH1 | 0.0031 |
| 324 | 0.4018 | 0.4018 | LAMA4 | 0.0031 |
| 325 | 0.4018 | 0.4018 | RPS6KA5 | 0.0031 |
| 326 | 0.4062 | 0.4062 | TAB2, LBP | 0.0085 |
| 327 | 0.4062 | 0.4062 | ETNK1, GPD2 | 0.0085 |
| 328 | 0.4089 | 0.4089 | RHOB, ELMO2, PIK3CG | 0.0141 |
| 329 | 0.4106 | 0.4106 | NBN | 0.0032 |
| 330 | 0.4106 | 0.4106 | NR2F1 | 0.0032 |
| 331 | 0.4106 | 0.4106 | PRKAR2B | 0.0032 |
| 332 | 0.4106 | 0.4106 | RFC3 | 0.0032 |
| 333 | 0.4106 | 0.4106 | ARTN | 0.0032 |
| 334 | 0.4106 | 0.4106 | PGM2 | 0.0032 |
| 335 | 0.4128 | 0.4128 | RPS6KA5, TIAM2, ARHGEF7 | 0.0142 |
| 336 | 0.4164 | 0.4164 | CD34, CD59 | 0.0087 |
| 337 | 0.4192 | 0.4192 | LAMA3 | 0.0033 |
| 338 | 0.4192 | 0.4192 | ARHGAP6 | 0.0033 |
| 339 | 0.4192 | 0.4192 | MTOR | 0.0033 |
| 340 | 0.4214 | 0.4214 | ADCY2, PIK3CG | 0.0088 |
| 341 | 0.4214 | 0.4214 | PSMD6, RFC3 | 0.0088 |
| 342 | 0.4264 | 0.4264 | SYNJ2, PIK3CG | 0.0088 |
| 343 | 0.4264 | 0.4264 | ADCY2, PIK3CG | 0.0088 |
| 344 | 0.4277 | 0.4277 | TAB2 | 0.0034 |
| 345 | 0.4277 | 0.4277 | TAB2 | 0.0034 |
| 346 | 0.4277 | 0.4277 | GNG2 | 0.0034 |
| 347 | 0.4277 | 0.4277 | EFNB1 | 0.0034 |
| 348 | 0.4277 | 0.4277 | RFC3 | 0.0034 |
| 349 | 0.436 | 0.436 | PIK3CG | 0.0035 |
| 350 | 0.4364 | 0.4364 | PIK3CG, MTOR | 0.009 |
| 351 | 0.4443 | 0.4443 | MTOR | 0.0036 |
| 352 | 0.4443 | 0.4443 | KIF23 | 0.0036 |
| 353 | 0.4443 | 0.4443 | MTOR | 0.0036 |
| 354 | 0.4443 | 0.4443 | SNAP25 | 0.0036 |
| 355 | 0.4443 | 0.4443 | GRM1 | 0.0036 |
| 356 | 0.4443 | 0.4443 | GABARAPL1 | 0.0036 |
| 357 | 0.4463 | 0.4463 | PIK3CG, MTOR | 0.0092 |
| 358 | 0.4512 | 0.4512 | TLR2, PIK3CG | 0.0093 |
| 359 | 0.4524 | 0.4524 | PPP3R1 | 0.0037 |
| 360 | 0.4524 | 0.4524 | RPS6KA5 | 0.0037 |
| 361 | 0.4524 | 0.4524 | PRKAR2B | 0.0037 |
| 362 | 0.4524 | 0.4524 | TAB2 | 0.0037 |
| 363 | 0.4524 | 0.4524 | DGAT2 | 0.0037 |
| 364 | 0.4524 | 0.4524 | ARHGEF7 | 0.0037 |
| 365 | 0.4524 | 0.4524 | NBN | 0.0037 |
| 366 | 0.4551 | 0.4551 | GABARAPL1, CTSB, TAB2 | 0.0152 |
| 367 | 0.4561 | 0.4561 | PPP3R1, PIK3CG | 0.0094 |
| 368 | 0.4589 | 0.4589 | CYFIP1, SUMO4, NXF3 | 0.0153 |
| 369 | 0.4604 | 0.4604 | GNG2 | 0.0038 |
| 370 | 0.4609 | 0.4609 | GLCE, SDC1 | 0.0095 |
| 371 | 0.4658 | 0.4658 | GATA4, KCNIP4 | 0.0096 |
| 372 | 0.4683 | 0.4683 | TAB2 | 0.0038 |
| 373 | 0.474 | 0.474 | ADCY2, AK5, PGM2 | 0.0156 |
| 374 | 0.4753 | 0.4753 | PIK3CG, MTOR | 0.0097 |
| 375 | 0.476 | 0.476 | TREM1 | 0.0039 |
| 376 | 0.476 | 0.476 | PSMD6 | 0.0039 |
| 377 | 0.4801 | 0.4801 | LBP, OPRM1 | 0.0098 |
| 378 | 0.4837 | 0.4837 | ABCB11 | 0.004 |
| 379 | 0.4837 | 0.4837 | NBN | 0.004 |
| 380 | 0.4837 | 0.4837 | RFC3 | 0.004 |
| 381 | 0.4837 | 0.4837 | SCAI | 0.004 |
| 382 | 0.4837 | 0.4837 | UGT8 | 0.004 |
| 383 | 0.4837 | 0.4837 | FBXW7 | 0.004 |
| 384 | 0.4837 | 0.4837 | TAF7 | 0.004 |
| 385 | 0.4889 | 0.4889 | IFT172, PRKAR2B, MKKS | 0.016 |
| 386 | 0.4889 | 0.4889 | PPP3R1, TLR2, LBP | 0.016 |
| 387 | 0.4912 | 0.4912 | PIK3CG | 0.0041 |
| 388 | 0.4912 | 0.4912 | ARHGAP6 | 0.0041 |
| 389 | 0.4987 | 0.4987 | RUNX2 | 0.0042 |
| 390 | 0.4987 | 0.4987 | RFC3 | 0.0042 |
| 391 | 0.4987 | 0.4987 | LBP | 0.0042 |
| 392 | 0.4987 | 0.4987 | SDC1 | 0.0042 |
| 393 | 0.4987 | 0.4987 | TAB2 | 0.0042 |
| 394 | 0.4987 | 0.4987 | UGT8 | 0.0042 |
| 395 | 0.4999 | 0.4999 | PPP3R1, ADCY2, GRM1 | 0.0163 |

TABLE 6.a1

| | GeneSet | No_in_Gene_Set | In_List | P-value |
|---|---|---|---|---|
| 1 | Pathways in cancer(K) | 397 | 19 | 0.0000204 |
| 2 | Huma papillomavirus infection(K) | 313 | 15 | 0.000155 |
| 3 | Basal cell carcinoma(K) | 55 | 6 | 0.000270 |
| 4 | PI3K-Akt signaling pathway(K) | 341 | 15 | 0.000382 |
| 5 | Toxoplasmosis(K) | 118 | 8 | 0.000646 |
| 6 | Insulin Pathway(N) | 45 | 5 | 0.000812 |
| 7 | G alpha (i) signalling events(R) | 345 | 14 | 0.00129 |
| 8 | ECM-receptor interaction(K) | 82 | 6 | 0.00210 |
| 9 | IL8- and CXCR2-mediated signaling events(N) | 34 | 4 | 0.00222 |
| 10 | Protein repair(R) | 5 | 2 | 0.00295 |
| 11 | 5HT1 type receptor mediated signaling pathway(P) | 19 | 3 | 0.00357 |
| 12 | Class I MHC mediated antigen processing & presentation(R) | 191 | 9 | 0.00363 |
| 13 | Focal adhesion(K) | 201 | 9 | 0.00504 |
| 14 | Proteoglycans in cancer(K) | 205 | 9 | 0.00570 |
| 15 | Melanogenesis(K) | 101 | 6 | 0.00574 |
| 16 | agrin in postsynaptic differentiation(B) | 45 | 4 | 0.00596 |
| 17 | NOD-like receptor signaling pathway(K) | 170 | 8 | 0.00603 |
| 18 | 5HT4 type receptor mediated signaling pathway(P) | 23 | 3 | 0.00605 |
| 19 | Measles(K) | 136 | 7 | 0.00628 |
| 20 | TGF-beta receptor signaling(N) | 47 | 4 | 0.00693 |
| 21 | Wnt signaling pathway(K) | 143 | 7 | 0.00815 |
| 22 | Alzheimer disease-presenilin pathway(P) | 111 | 6 | 0.00890 |
| 23 | Signaling by PDGF(R) | 51 | 4 | 0.00915 |
| 24 | Beta-catenin independent WNT signaling(R) | 112 | 6 | 0.00927 |
| 25 | Beta1 adrenergic receptor signaling pathway(P) | 27 | 3 | 0.00935 |
| 26 | Translocation of GLUT4 to the plasma membrane(R) | 52 | 4 | 0.00977 |
| 27 | Wnt signaling network(N) | 28 | 3 | 0.0103 |
| 28 | IL8- and CXCR1-mediated signaling events(N) | 28 | 3 | 0.0103 |
| 29 | Hedgehog signaling pathway(P) | 10 | 2 | 0.0112 |
| 30 | mTOR signaling pathway(K) | 154 | 7 | 0.0119 |
| 31 | TCR signaling(R) | 123 | 6 | 0.0141 |
| 32 | G-protein beta:gamma signalling(R) | 32 | 3 | 0.0147 |
| 33 | Choline catabolismr) | 1 | 1 | 0.0157 |
| 34 | Integration of energy metabolism(R) | 92 | 5 | 0.0161 |
| 35 | Signaling by VEGF(R) | 94 | 5 | 0.0175 |
| 36 | CXCR3-mediated signaling events(N) | 35 | 3 | 0.0186 |
| 37 | African trypanosomiasis(K) | 35 | 3 | 0.0186 |
| 38 | Rap1 signaling pathway(K) | 212 | 8 | 0.0204 |
| 39 | Amoebiasis(K) | 98 | 5 | 0.0205 |
| 40 | Beta1 integrin cell surface interactions(N) | 66 | 4 | 0.0214 |
| 41 | Cadherin signaling pathway(P) | 100 | 5 | 0.0221 |
| 42 | C-type lectin receptors (CLRs)(R) | 139 | 6 | 0.024 |
| 43 | Aldosterone-regulated sodium reabsorption(K) | 39 | 3 | 0.0246 |
| 44 | FOXM1 transcription factor network(N) | 40 | 3 | 0.0262 |
| 45 | Ligand-dependent caspase activation(R) | 16 | 2 | 0.027 |
| 46 | Wnt signaling pathway(P) | 267 | 9 | 0.0272 |
| 47 | Toll-like receptor signaling pathway(K) | 106 | 5 | 0.0275 |
| 48 | Inflammation mediated by chemokine and cytokine signaling pathway(P) | 72 | 4 | 0.0283 |
| 49 | Leishmaniasis(K) | 73 | 4 | 0.0295 |
| 50 | Hepatitis B(K) | 146 | 6 | 0.0296 |
| 51 | Breast cancer(K) | 146 | 6 | 0.0296 |
| 52 | FOXA1 transcription factor network(N) | 42 | 3 | 0.0297 |
| 53 | Platinum drug resistance(K) | 75 | 4 | 0.0321 |
| 54 | Validated transcriptional targets of deltaNp63 isoforms(N) | 45 | 3 | 0.0353 |
| 55 | Integrin-linked kinase signaling(N) | 45 | 3 | 0.0353 |
| 56 | Hippo signaling pathway(K) | 154 | 6 | 0.0368 |
| 57 | Calcineurin-regulated NFAT-dependent transcription in lymphocytes(N) | 46 | 3 | 0.0373 |
| 58 | CXCR4-mediated signaling events(N) | 80 | 4 | 0.0392 |
| 59 | Hedgehog signaling events mediated by Gli proteins(N) | 48 | 3 | 0.0414 |
| 60 | Hedgehog 'on' state(R) | 82 | 4 | 0.0422 |
| 61 | Malaria(K) | 49 | 3 | 0.0436 |
| 62 | Beta2 adrenergic receptor signaling pathway(P) | 21 | 2 | 0.0442 |
| 63 | Beta3 adrenergic receptor signaling pathway(P) | 21 | 2 | 0.0442 |
| 64 | Oxytocin receptor mediated signaling pathway(P) | 21 | 2 | 0.0442 |
| 65 | GABA-B_receptor_Il_signaling(P) | 3 | 1 | 0.0464 |
| 66 | Insulin secretion(K) | 85 | 4 | 0.047 |
| 67 | Cell cycle(K) | 124 | 5 | 0.0483 |
| 68 | EPH-Ephrin signaling(R) | 86 | 4 | 0.0487 |
| 69 | Endometrial cancer(K) | 52 | 3 | 0.0503 |
| 70 | G alpha (z) signalling events(R) | 23 | 2 | 0.052 |
| 71 | Mismatch repair(K) | 23 | 2 | 0.052 |
| 72 | Prostate cancer(K) | 89 | 4 | 0.0539 |
| 73 | Morphine addiction(K) | 91 | 4 | 0.0576 |
| 74 | Interleukin-12 family signaling(R) | 55 | 3 | 0.0576 |
| 75 | Endogenous TLR signaling(N) | 25 | 2 | 0.0602 |
| 76 | Cortocotropin releasing factor receptor signaling pathway(P) | 25 | 2 | 0.0602 |
| 77 | Proteoglycan syndecan-mediated signaling events(N) | 4 | 1 | 0.0613 |
| 78 | generation of amyloid b-peptide by ps1(B) | 4 | 1 | 0.0613 |

TABLE 6.a1-continued

| GeneSet | No_in_Gene_Set | In_List | P-value |
|---|---|---|---|
| 79 Galactose catabolismr) | 4 | 1 | 0.0613 |
| 80 ifn gamma signaling pathway(B) | 4 | 1 | 0.0613 |
| 81 Axon guidance(K) | 177 | 6 | 0.0636 |
| 82 5HT2 type receptor mediated signaling pathway(P) | 26 | 2 | 0.0644 |
| 83 ALK1 signaling events(N) | 26 | 2 | 0.0644 |
| 84 Neddylation(R) | 223 | 7 | 0.0655 |
| 85 Circadian entrainment(K) | 96 | 4 | 0.0672 |
| 86 Calcium signaling in the CD4+ TCR pathway(N) | 27 | 2 | 0.0688 |
| 87 VEGFR1 specific signals(N) | 27 | 2 | 0.0688 |
| 88 Integrin signaling(R) | 27 | 2 | 0.0688 |
| 89 Neutrophil degranulation(R) | 418 | 11 | 0.0696 |
| 90 Signaling events mediated by focal adhesion kinase(N) | 60 | 3 | 0.0707 |
| 91 Neurotrophic factor-mediated Trk receptor signaling(N) | 60 | 3 | 0.0707 |
| 92 Progesterone-mediated oocyte maturation(K) | 98 | 4 | 0.0713 |
| 93 Insulin signaling pathway(K) | 140 | 5 | 0.0729 |
| 94 Estrogen signaling pathway(K) | 100 | 4 | 0.0755 |
| 95 PLK3 signaling events(N) | 5 | 1 | 0.0761 |
| 96 Signaling pathways regulating pluripotency of stem cells(K) | 142 | 5 | 0.0764 |
| 97 Chemokine signaling pathway(K) | 187 | 6 | 0.0781 |
| 98 Neurotransmitter receptors and postsynaptic signal transmission(R) | 143 | 5 | 0.0782 |
| 99 Hedgehog ligand biogenesis(R) | 63 | 3 | 0.0792 |
| 100 Cell adhesion molecules (CAMs)(K) | 145 | 5 | 0.0818 |
| 101 Glucagon signaling pathway(K) | 103 | 4 | 0.0821 |
| 102 mTOR signaling pathway(N) | 64 | 3 | 0.0821 |
| 103 Citrate cycle (TCA cycle)(K) | 30 | 2 | 0.0824 |
| 104 Chagas disease (American trypanosomiasis) (K) | 104 | 4 | 0.0843 |
| 105 Inflammatory bowel disease (IBD)(K) | 65 | 3 | 0.0851 |
| 106 Costimulation by the CD28 family(R) | 65 | 3 | 0.0851 |
| 107 neuroregulin receptor degredation protein-1 controls erbb3 receptor recycling(B) | 6 | 1 | 0.0906 |
| 108 e2f1 destruction pathway(B) | 6 | 1 | 0.0906 |
| 109 Glypican 3 network(N) | 6 | 1 | 0.0906 |
| 110 Propanoate metabolism(K) | 32 | 2 | 0.0919 |

TABLE 6.a2

| | FDR | Nodes | RatioOfProtein-InGeneSet |
|---|---|---|---|
| 1 | 0.0119 | CBLB, FZD3, FZD9, GLI3, SHH, PLCB1, ADCY2, CTNNA2, PGF, MSH2, WNT2, CDK6, FGF12, FGFR2, CCNA1, LAMA4, LAMA3, GNG2, TCF7L2 | 0.0355 |
| 2 | 0.0453 | FZD3, FZD9, COL9A1, IKBKE, MAGI1, WNT2, CDK6, DLG2, CCNA1, COL6A1, CREB5, LAMA4, LAMA3, THBS2, TCF7L2 | 0.028 |
| 3 | 0.0527 | FZD3, FZD9, GLI3, SHH, WNT2, TCF7L2 | 0.0049 |
| 4 | 0.0557 | COL9A1, SGK1, TLR4, PGF, CDK6, FGF12, FGFR2, GHR, PDPK1, COL6A1, CREB5, LAMA4, LAMA3, THBS2, GNG2 | 0.0305 |
| 5 | 0.0755 | IL12B, IFNGR1, TLR4, LY96, TAB2, PDPK1, LAMA4, LAMA3 | 0.0105 |
| 6 | 0.0788 | RAPGEF1, SGK1, RHOQ, EXOC2, PDPK1 | 0.004 |
| 7 | 0.1067 | GPR183, SDC1, GPR18, OXGR1, PLCB1, ADCY2, CCL20, STRA6, PDE4B, OPRM1, SSTR1, CX3CR1, GNG2, METAP2 | 0.0308 |
| 8 | 0.1444 | COL9A1, SDC1, COL6A1, LAMA4, LAMA3, THBS2 | 0.0073 |
| 9 | 0.1444 | PLCB1, ELMO1, PDPK1, GNG2 | 0.003 |
| 10 | 0.1713 | MSRA, MSRB2 | 0.0004 |
| 11 | 0.1744 | ADCY2, SNAP23, GNG2 | 0.0017 |
| 12 | 0.1744 | HERC5, PSMD6, HERC6, NEDD4L, TLR4, PSMB2, FBXW2, LY96, SNAP23 | 0.0171 |
| 13 | 0.1885 | COL9A1, RAPGEF1, PAK3, PGF, PDPK1, COL6A1, LAMA4, LAMA3, THBS2 | 0.018 |
| 14 | 0.1885 | CBLB, IL12B, FZD3, FZD9, SDC1, SHH, TLR4, WNT2, PDPK1 | 0.0183 |
| 15 | 0.1885 | FZD3, FZD9, PLCB1, ADCY2, WNT2, TCF7L2 | 0.009 |
| 16 | 0.1885 | ARHGEF7, PAK3, NRG3, LAMA3 | 0.004 |

TABLE 6.a2-continued

| | FDR | Nodes | RatioOfProtein-InGeneSet |
|---|---|---|---|
| 17 | 0.1885 | GABARAPL1, IKBKE, PLCB1, TLR4, TAB2, CASP4, AIM2, IFI16 | 0.0152 |
| 18 | 0.1885 | ADCY2, SNAP23, GNG2 | 0.0021 |
| 19 | 0.1885 | CBLB, IL12B, IKBKE, IFNGR1, TLR4, CDK6, TAB2 | 0.0122 |
| 20 | 0.2009 | NEDD4L, FKBP1A, TAB2, PDPK1 | 0.0042 |
| 21 | 0.2062 | SFRP5, FZD3, FZD9, PLCB1, PRICKLE2, WNT2, TCF7L2 | 0.0128 |
| 22 | 0.2062 | FZD3, FZD9, CTNNA2, WNT2, ACTR2, TCF7L2 | 0.0099 |
| 23 | 0.2062 | COL9A1, RAPGEF1, COL6A1, THBS2 | 0.0046 |
| 24 | 0.2062 | PSMD6, FZD3, PLCB1, PSMB2, GNG2, TCF7L2 | 0.01 |
| 25 | 0.2062 | ADCY2, SNAP23, GNG2 | 0.0024 |
| 26 | 0.2062 | RHOQ, EXOC2, SNAP23, TBC1D1 | 0.0046 |
| 27 | 0.2062 | FZD9, WNT2, ATP6AP2 | 0.0025 |
| 28 | 0.2062 | PLCB1, PDPK1, GNG2 | 0.0025 |
| 29 | 0.2244 | GLI3, SHH | 0.0009 |
| 30 | 0.2257 | ATP6V1E2, FZD3, FZD9, SGK1, RICTOR, WNT2, PDPK1 | 0.0138 |
| 31 | 0.2545 | PSMD6, FYB1, PSMB2, PAK3, TAB2, PDPK1 | 0.011 |
| 32 | 0.2647 | PLCB1, PDPK1, GNG2 | 0.0029 |
| 33 | 0.2669 | SLC44A1 | 0.0001 |
| 34 | 0.2738 | KCNC2, RAPGEF4, ADCY2, AKAP5, GNG2 | 0.0082 |
| 35 | 0.2789 | RICTOR, PAK3, PGF, ELMO1, PDPK1 | 0.0084 |
| 36 | 0.2789 | RICTOR, PDPK1, GNG2 | 0.0031 |
| 37 | 0.2789 | IL12B, PLCB1, LAMA4 | 0.0031 |
| 38 | 0.3001 | RAPGEF1, PLCB1, RAPGEF4, ADCY2, MAGI1, PGF, FGF12, FGFR2 | 0.019 |
| 39 | 0.3001 | IL12B, PLCB1, TLR4, LAMA4, LAMA3 | 0.0088 |
| 40 | 0.3001 | COL6A1, LAMA4, LAMA3, THBS2 | 0.0059 |
| 41 | 0.3007 | FZD3, FZD9, CTNNA2, WNT2, CDH17 | 0.0089 |
| 42 | 0.3007 | PSMD6, PSMB2, PAK3, CLEC7A, TAB2, PDPK1 | 0.0124 |
| 43 | 0.3007 | NEDD4L, SGK1, PDPK1 | 0.0035 |
| 44 | 0.3007 | CHEK2, CCNB2, LAMA4 | 0.0036 |
| 45 | 0.3007 | TLR4, LY96 | 0.0014 |
| 46 | 0.3007 | SFRP5, FZD3, FZD9, PLCB1, CTNNA2, WNT2, CDH17, GNG2, TCF7L2 | 0.0239 |
| 47 | 0.3007 | IL12B, IKBKE, TLR4, LY96, TAB2 | 0.0095 |
| 48 | 0.3007 | PLCB1, CCL20, PDPK1, COL6A1 | 0.0064 |
| 49 | 0.3007 | IL12B, IFNGR1, TLR4, TAB2 | 0.0065 |
| 50 | 0.3007 | EGR3, IKBKE, TLR4, CDK6, CCNA1, CREB5 | 0.0131 |
| 51 | 0.3007 | FZD3, FZD9, WNT2, CDK6, FGF12, TCF7L2 | 0.0131 |
| 52 | 0.3007 | NR2F2, SHH, DSCAM | 0.0038 |
| 53 | 0.3007 | GSTO2, GSTO1, MSH2, PDPK1 | 0.0067 |
| 54 | 0.3007 | HBP1, RAB38, CCNB2 | 0.004 |
| 55 | 0.3007 | TNS1, ARHGEF7, RICTOR | 0.004 |

TABLE 6.a2-continued

| | FDR | Nodes | RatioOfProtein-InGeneSet |
|---|---|---|---|
| 56 | 0.3007 | FZD3, FZD9, CTNNA2, WNT2, DLG2, TCF7L2 | 0.0138 |
| 57 | 0.3007 | CBLB, EGR3, IRF4 | 0.0041 |
| 58 | 0.3007 | PLCB1, RICTOR, PDPK1, GNG2 | 0.0072 |
| 59 | 0.3007 | GLI3, SHH, GNG2 | 0.0043 |
| 60 | 0.3007 | PSMD6, GLI3, SHH, PSMB2 | 0.0073 |
| 61 | 0.3007 | SDC1, TLR4, THBS2 | 0.0044 |
| 62 | 0.3007 | SNAP23, GNG2 | 0.0019 |
| 63 | 0.3007 | SNAP23, GNG2 | 0.0019 |
| 64 | 0.3007 | SNAP23, GNG2 | 0.0019 |
| 65 | 0.3007 | ADCY2 | 0.0003 |
| 66 | 0.3007 | PLCB1, RAPGEF4, ADCY2, CREB5 | 0.0076 |
| 67 | 0.3007 | CHEK2, PTTG2, CCNB2, CDK6, CCNA1 | 0.0111 |
| 68 | 0.3007 | ARHGEF7, PAK3, ADAM10, ACTR2 | 0.0077 |
| 69 | 0.3007 | CTNNA2, PDPK1, TCF7L2 | 0.0046 |
| 70 | 0.3007 | ADCY2, GNG2 | 0.0021 |
| 71 | 0.3007 | MSH2, RFC3 | 0.0021 |
| 72 | 0.3007 | FGFR2, PDPK1, CREB5, TCF7L2 | 0.008 |
| 73 | 0.3007 | ADCY2, PDE4B, OPRM1, GNG2 | 0.0081 |
| 74 | 0.3007 | IL12B, GSTO1, LCP1 | 0.0049 |
| 75 | 0.3007 | TLR4, LY96 | 0.0022 |
| 76 | 0.3007 | SNAP23, GNG2 | 0.0022 |
| 77 | 0.3007 | SDC1 | 0.0004 |
| 78 | 0.3007 | ADAM10 | 0.0004 |
| 79 | 0.3007 | PGM2 | 0.0004 |
| 80 | 0.3007 | IFNGR1 | 0.0004 |
| 81 | 0.3007 | PDK1, FZD3, SHH, PAK3, SRGAP3, SRGAP2 | 0.0158 |
| 82 | 0.3007 | SNAP23, GNG2 | 0.0023 |
| 83 | 0.3007 | FKBP1A, INHBA | 0.0023 |
| 84 | 0.3007 | PSMD6, PUM2, PSMB2, KCTD6, FBXW2, TULP4, ASB17 | 0.0199 |
| 85 | 0.3007 | PLCB1, ADCY2, GUCY1A2, GNG2 | 0.0086 |
| 86 | 0.3007 | AKAP5, FKBP1A | 0.0024 |
| 87 | 0.3007 | PGF, PDPK1 | 0.0024 |
| 88 | 0.3007 | RAPGEF4, PDPK1 | 0.0024 |
| 89 | 0.3007 | PSMD6, OLR1, CD58, FRK, ADAM10, SNAP23, PGM2, ACTR2, ATP6AP2, LTF, VAPA | 0.0374 |
| 90 | 0.3007 | RAPGEF1, ARHGEF7, ELMO1 | 0.0054 |
| 91 | 0.3007 | NEDD4L, RAPGEF1, ELMO1 | 0.0054 |
| 92 | 0.3007 | CPEB4, ADCY2, CCNB2, CCNA1 | 0.0088 |
| 93 | 0.3007 | CBLB, PPP1R3D, RAPGEF1, RHOQ, PDPK1 | 0.0125 |

TABLE 6.a2-continued

| | FDR | Nodes | RatioOfProtein-InGeneSet |
|---|---|---|---|
| 94 | 0.3007 | PLCB1, ADCY2, OPRM1, CREB5 | 0.0089 |
| 95 | 0.3007 | CHEK2 | 0.0004 |
| 96 | 0.3007 | FZD3, FZD9, WNT2, INHBA, FGFR2 | 0.0127 |
| 97 | 0.3007 | PLCB1, ADCY2, CCL20, ELMO1, CX3CR1, GNG2 | 0.0167 |
| 98 | 0.3007 | PLCB1, ADCY2, AKAP5, PDPK1, GNG2 | 0.0128 |
| 99 | 0.3007 | PSMD6, SHH, PSMB2 | 0.0056 |
| 100 | 0.3007 | ALCAM, SDC1, CD58, CNTNAP2, NLGN4Y | 0.013 |
| 101 | 0.3007 | LDHAL6B, PLCB1, ADCY2, CREB5 | 0.0092 |
| 102 | 0.3007 | SGK1, RICTOR, PDPK1 | 0.0057 |
| 103 | 0.3007 | SUCLG2, DLST | 0.0027 |
| 104 | 0.3007 | IL12B, IFNGR1, PLCB1, TLR4 | 0.0093 |
| 105 | 0.3007 | IL12B, IFNGR1, TLR4 | 0.0058 |
| 106 | 0.3007 | RICTOR, PAK3, PDPK1 | 0.0058 |
| 107 | 0.3007 | NRG3 | 0.0005 |
| 108 | 0.3007 | CCNA1 | 0.0005 |
| 109 | 0.3007 | SHH | 0.0005 |
| 110 | 0.3007 | SUCLG2, LDHAL6B | 0.0029 |

TABLE 6.b1

| | GeneSet | No_in_Gene_Set | In_List |
|---|---|---|---|
| 111 | Heterotrimeric G-protein signaling pathway-Gq alpha and Go alpha mediated pathway(P) | 108 | 4 |
| 112 | p53 signaling pathway(K) | 69 | 3 |
| 113 | Cell Cycle Checkpoints(R) | 246 | 7 |
| 114 | Phagosome(K) | 154 | 5 |
| 115 | CAMP signaling pathway(K) | 200 | 6 |
| 116 | Degradation of beta-catenin by the destruction complex(R) | 70 | 3 |
| 117 | Cholinergic synapse(K) | 111 | 4 |
| 118 | SNARE interactions in vesicular transport(K) | 34 | 2 |
| 119 | Internalization of ErbB1(N) | 35 | 2 |
| 120 | Class I PI3K signaling events mediated by Akt(N) | 35 | 2 |
| 121 | PPAR signaling pathway(K) | 72 | 3 |
| 122 | Arrhythmogenic right ventricular cardiomyopathy (ARVC)(K) | 72 | 3 |
| 123 | Integrin signalling pathway(P) | 158 | 5 |
| 124 | Metabolism of xenobiotics by cytochrome P450(K) | 74 | 3 |
| 125 | Signaling by Insulin receptor(R) | 74 | 3 |
| 126 | Thyroid hormone synthesis(K) | 74 | 3 |
| 127 | The citric acid (TCA) cycle and respiratory electron transport(R) | 162 | 5 |
| 128 | Platelet Aggregation (Plug Formation)(R) | 37 | 2 |
| 129 | ATR signaling pathway(N) | 37 | 2 |
| 130 | HTLV-I infection(K) | 258 | 7 |
| 131 | sonic hedgehog receptor ptc1 regulates cell cycle(B) | 8 | 1 |
| 132 | chaperones modulate interferon signaling pathway(B) | 8 | 1 |
| 133 | Rapid glucocorticoid signaling(N) | 8 | 1 |
| 134 | Pertussis(K) | 76 | 3 |
| 135 | Regulation of RAC1 activity(N) | 38 | 2 |
| 136 | Nucleotide-binding domain, leucine rich repeat containing receptor (NLR) signaling pathways(R) | 38 | 2 |
| 137 | Extracellular matrix organization(R) | 261 | 7 |
| 138 | Bacterial invasion of epithelial cells(K) | 78 | 3 |
| 139 | Platelet activation(K) | 122 | 4 |
| 140 | IFN-gamma pathway(N) | 40 | 2 |
| 141 | Class I PI3K signaling events(N) | 40 | 2 |
| 142 | Pentose phosphate pathway (hexose monophosphate shunt)(R) | 9 | 1 |
| 143 | Signaling events mediated by Hepatocyte Growth Factor Receptor (c-Met)(N) | 80 | 3 |
| 144 | AMPK signaling pathway(K) | 124 | 4 |

TABLE 6.b1-continued

| GeneSet | No_in_Gene_Set | In_List |
|---|---|---|
| 145 Oocyte meiosis(K) | 124 | 4 |
| 146 Signaling by EGFR(R) | 41 | 2 |
| 147 Chemical carcinogenesis(K) | 82 | 3 |
| 148 C-MYB transcription factor network(N) | 82 | 3 |
| 149 Aldosterone synthesis and secretion(K) | 82 | 3 |
| 150 PIP3 activates AKT signaling(R) | 222 | 6 |
| 151 Plasma membrane estrogen receptor signaling(N) | 42 | 2 |
| 152 no2-dependent il-12 pathway in nk cells(B) | 10 | 1 |
| 153 5HT3 type receptor mediated signaling pathway(P) | 10 | 1 |
| 154 g-secretase mediated erbb4 signaling pathway(B) | 10 | 1 |
| 155 VEGF and VEGFR signaling network(N) | 10 | 1 |
| 156 PAR1-mediated thrombin signaling events(N) | 43 | 2 |
| 157 Beta3 integrin cell surface interactions(N) | 43 | 2 |
| 158 Relaxin signaling pathway(K) | 130 | 4 |
| 159 HDR through Homologous Recombination (HR) or Single Strand Annealing (SSA)(R) | 85 | 3 |
| 160 Mitotic G2-G2/M phases(R) | 178 | 5 |
| 161 Proteasome(K) | 44 | 2 |
| 162 Small cell lung cancer(K) | 86 | 3 |
| 163 Ras signaling pathway(K) | 229 | 6 |
| 164 Mitotic G1-G1/S phases(R) | 132 | 4 |
| 165 Kaposi's sarcoma-associated herpesvirus infection(K) | 180 | 5 |
| 166 trans-Golgi Network Vesicle Budding(R) | 45 | 2 |
| 167 ALK2 signaling events(N) | 11 | 1 |
| 168 Histidine, lysine, phenylalanine, tyrosine, proline and tryptophan catabolism | 11 | 1 |
| 169 Alpha6 beta4 integrin-ligand interactions(N) | 11 | 1 |
| 170 how does salmonella hijack a cell(B) | 11 | 1 |
| 171 Potassium Channels(R) | 87 | 3 |
| 172 ErbB signaling pathway(K) | 88 | 3 |
| 173 GABAergic synapse(K) | 88 | 3 |
| 174 Gap junction(K) | 88 | 3 |
| 175 FoxO signaling pathway(K) | 134 | 4 |
| 176 TNF receptor signaling pathway(N) | 46 | 2 |
| 177 Post-translational modification: synthesis of GPI-anchored proteins(R) | 89 | 3 |
| 178 MAPK6/MAPK4 signaling(R) | 89 | 3 |
| 179 Signaling by Rho GTPases(R) | 338 | 8 |
| 180 Apelin signaling pathway(K) | 136 | 4 |
| 181 FGF signaling pathway(N) | 47 | 2 |
| 182 Hedgehog signaling pathway(K) | 47 | 2 |
| 183 Interleukin-10 signaling(R) | 47 | 2 |
| 184 Herpes simplex infection(K) | 185 | 5 |
| 185 Hedgehog 'off' state(R) | 90 | 3 |
| 186 Protein digestion and absorption(K) | 90 | 3 |
| 187 Rheumatoid arthritis(K) | 90 | 3 |
| 188 Salivary secretion(K) | 90 | 3 |
| 189 Signaling by NOTCH4(R) | 12 | 1 |
| 190 estrogen responsive protein efp controls cell cycle and breast tumors growth (B) | 12 | 1 |
| 191 Peptide hormone biosynthesis(R) | 12 | 1 |
| 192 Signal regulatory protein family interactions(R) | 12 | 1 |
| 193 Amino sugar and nucleotide sugar metabolism(K) | 48 | 2 |
| 194 Posttranslational regulation of adherens junction stability and dissassembly (N) | 48 | 2 |
| 195 Fluid shear stress and atherosclerosis(K) | 139 | 4 |
| 196 Validated transcriptional targets of TAp63 isoforms(N) | 49 | 2 |
| 197 IL-17 signaling pathway(K) | 93 | 3 |
| 198 Histamine H1 receptor mediated signaling pathway(P) | 13 | 1 |
| 199 fibrinolysis pathway(B) | 13 | 1 |
| 200 Metabolism of Angiotensinogen to Angiotensins(R) | 13 | 1 |
| 201 Histamine H2 receptor mediated signaling pathway(P) | 13 | 1 |
| 202 Signaling by Activin(R) | 13 | 1 |
| 203 Thyrotropin-releasing hormone receptor signaling pathway(P) | 13 | 1 |
| 204 il12 and stat4 dependent signaling pathway in th1 development(B) | 13 | 1 |
| 205 Ovarian steroidogenesis(K) | 50 | 2 |
| 206 Neurexins and neuroligins(R) | 50 | 2 |
| 207 NF-kappa B signaling pathway(K) | 95 | 3 |
| 208 Toll-Like Receptors Cascades(R) | 143 | 4 |
| 209 Signaling by Type 1 Insulin-like Growth Factor 1 Receptor (IGF1R)(R) | 51 | 2 |
| 210 Pancreatic secretion(K) | 96 | 3 |
| 211 lon channel transport(R) | 145 | 4 |
| 212 Peroxisomal lipid metabolism(R) | 14 | 1 |
| 213 Nucleotide salvage(R) | 14 | 1 |
| 214 Role of Calcineurin-dependent NFAT signaling in lymphocytes(N) | 52 | 2 |
| 215 Signaling events mediated by Stem cell factor receptor (c-Kit)(N) | 52 | 2 |
| 216 Class B/2 (Secretin family receptors)(R) | 52 | 2 |
| 217 Synthesis of DNA(R) | 98 | 3 |
| 218 Regulation of Apoptosis(R) | 53 | 2 |
| 219 Heterotrimeric G-protein signaling pathway-Gi alpha and Gs alpha mediated | 147 | 4 |

TABLE 6.b1-continued

| GeneSet | No_in_Gene_Set | In_List |
|---|---|---|
| pathway(P) | | |
| 220 Glutathione metabolism(K) | 54 | 2 |

TABLE 6.b2

| | P-value | FDR | Nodes | RatioOfProteinInGeneSet |
|---|---|---|---|---|
| 111 | 0.0936 | 0.3007 | PLCB1, OPRM1, SSTR1, GNG2 | 0.0097 |
| 112 | 0.0974 | 0.3007 | CHEK2, CCNB2, CDK6 | 0.0062 |
| 113 | 0.0974 | 0.3007 | PSMD6, CHEK2, PSMB2, CENPP, CCNB2, CLSPN, RFC3 | 0.022 |
| 114 | 0.0991 | 0.3007 | ATP6V1E2, OLR1, TLR4, CLEC7A, THBS2 | 0.0138 |
| 115 | 0.0995 | 0.3007 | GLI3, RAPGEF4, ADCY2, PDE4B, SSTR1, CREB5 | 0.0179 |
| 116 | 0.1005 | 0.3007 | PSMD6, PSMB2, TCF7L2 | 0.0063 |
| 117 | 0.1008 | 0.3007 | PLCB1, ADCY2, CREB5, GNG2 | 0.0099 |
| 118 | 0.1017 | 0.3007 | VTI1A, SNAP23 | 0.003 |
| 119 | 0.1067 | 0.3007 | CBLB, ARHGEF7 | 0.0031 |
| 120 | 0.1067 | 0.3007 | RICTOR, PDPK1 | 0.0031 |
| 121 | 0.107 | 0.3007 | OLR1, PDPK1, ACOX2 | 0.0064 |
| 122 | 0.107 | 0.3007 | CTNNA2, SGCG, TCF7L2 | 0.0064 |
| 123 | 0.1074 | 0.3007 | COL9A1, RAPGEF1, COL19A1, ELMO1, COL6A1 | 0.0141 |
| 124 | 0.1137 | 0.3007 | CYP1B1, GSTO2, GSTO1 | 0.0066 |
| 125 | 0.1137 | 0.3007 | ATP6V1E2, FGFR2, PDPK1 | 0.0066 |
| 126 | 0.1137 | 0.3007 | PLCB1, ADCY2, CREB5 | 0.0066 |
| 127 | 0.116 | 0.3007 | PDK1, SUCLG2, LDHAL6B, DLST, PDP1 | 0.0145 |
| 128 | 0.1169 | 0.3007 | RAPGEF4, PDPK1 | 0.0033 |
| 129 | 0.1169 | 0.3007 | CLSPN, RFC3 | 0.0033 |
| 130 | 0.117 | 0.3007 | CHEK2, FZD3, FZD9, ADCY2, PTTG2, CCNB2, WNT2 | 0.0231 |
| 131 | 0.1189 | 0.3007 | SHH | 0.0007 |
| 132 | 0.1189 | 0.3007 | IFNGR1 | 0.0007 |
| 133 | 0.1189 | 0.3007 | GNG2 | 0.0007 |
| 134 | 0.1205 | 0.3007 | IL12B, TLR4, LY96 | 0.0068 |
| 135 | 0.1221 | 0.3007 | ARHGEF7, ELMO1 | 0.0034 |
| 136 | 0.1221 | 0.3007 | TAB2, AIM2 | 0.0034 |
| 137 | 0.1221 | 0.3007 | COL9A1, SDC1, COL19A1, ADAM10, COL6A1, LAMA4, LAMA3 | 0.0233 |
| 138 | 0.1274 | 0.3007 | CBLB, CTNNA2, ELMO1 | 0.007 |
| 139 | 0.1295 | 0.3007 | PLCB1, ADCY2, GUCY1A2, SNAP23 | 0.0109 |
| 140 | 0.1326 | 0.3007 | IFNGR1, RAPGEF1 | 0.0036 |
| 141 | 0.1326 | 0.3007 | SGK1, PDPK1 | 0.0036 |
| 142 | 0.1328 | 0.3007 | PGM2 | 0.0008 |
| 143 | 0.1345 | 0.3007 | RIN2, RAPGEF1, PDPK1 | 0.0072 |
| 144 | 0.135 | 0.3007 | PDPK1, TBC1D1, CCNA1, CREB5 | 0.0111 |
| 145 | 0.135 | 0.3007 | CPEB4, ADCY2, PTTG2, CCNB2 | 0.0111 |
| 146 | 0.138 | 0.3007 | ARHGEF7, ADAM10 | 0.0037 |
| 147 | 0.1417 | 0.3007 | CYP1B1, GSTO2, GSTO1 | 0.0073 |
| 148 | 0.1417 | 0.3007 | CDK6, TAB2, CCNA1 | 0.0073 |
| 149 | 0.1417 | 0.3007 | PLCB1, ADCY2, CREB5 | 0.0073 |
| 150 | 0.142 | 0.3007 | PSMD6, PSMB2, RICTOR, FRK, FGFR2, PDPK1 | 0.0198 |
| 151 | 0.1434 | 0.3007 | PLCB1, GNG2 | 0.0038 |
| 152 | 0.1464 | 0.3007 | IL12B | 0.0009 |
| 153 | 0.1464 | 0.3007 | SNAP23 | 0.0009 |
| 154 | 0.1464 | 0.3007 | NRG3 | 0.0009 |
| 155 | 0.1464 | 0.3007 | PGF | 0.0009 |
| 156 | 0.1488 | 0.3007 | PLCB1, GNG2 | 0.0038 |
| 157 | 0.1488 | 0.3007 | SDC1, LAMA4 | 0.0038 |
| 158 | 0.1523 | 0.3007 | PLCB1, ADCY2, CREB5, GNG2 | 0.0116 |
| 159 | 0.1527 | 0.3007 | RAD51B, CLSPN, RFC3 | 0.0076 |
| 160 | 0.1534 | 0.3007 | PSMD6, PSMB2, CCNB2, HAUS2, CCNA1 | 0.0159 |
| 161 | 0.1543 | 0.3007 | PSMD6, PSMB2 | 0.0039 |
| 162 | 0.1565 | 0.3007 | CDK6, LAMA4, LAMA3 | 0.0077 |
| 163 | 0.1571 | 0.3007 | EXOC2, PAK3, PGF, FGF12, FGFR2, GNG2 | 0.0205 |
| 164 | 0.1582 | 0.3007 | PSMD6, PSMB2, CDK6, CCNA1 | 0.0118 |
| 165 | 0.1584 | 0.3007 | GABARAPL1, IKBKE, IFNGR1, CDK6, GNG2 | 0.0161 |
| 166 | 0.1598 | 0.3007 | SNAP23, SH3D19 | 0.004 |
| 167 | 0.1598 | 0.3007 | FKBP1A | 0.001 |
| 168 | 0.1598 | 0.3007 | DLST | 0.001 |
| 169 | 0.1598 | 0.3007 | LAMA3 | 0.001 |
| 170 | 0.1598 | 0.3007 | ACTR2 | 0.001 |
| 171 | 0.1603 | 0.3007 | KCNC2, KCNH8, GNG2 | 0.0078 |
| 172 | 0.1641 | 0.3007 | CBLB, PAK3, NRG3 | 0.0079 |
| 173 | 0.1641 | 0.3007 | GABARAPL1, ADCY2, GNG2 | 0.0079 |
| 174 | 0.1641 | 0.3007 | PLCB1, ADCY2, GUCY1A2 | 0.0079 |
| 175 | 0.1642 | 0.3007 | GABARAPL1, SGK1, CCNB2, PDPK1 | 0.012 |
| 176 | 0.1653 | 0.300 | MAP4K3, TAB2 | 0.0041 |
| 177 | 0.1679 | 0.3007 | CD109, PIGF, OPCML | 0.008 |
| 178 | 0.1679 | 0.3007 | PSMD6, PSMB2, PAK3 | 0.008 |

TABLE 6.b2-continued

| | P-value | FDR | Nodes | RatioOfProteinInGeneSet |
|---|---|---|---|---|
| 179 | 0.1691 | 0.3007 | ARHGEF7, RHOQ, PAK3, CENPP, SRGAP3, SRGAP2, ACTR2, PDPK1 | 0.0302 |
| 180 | 0.1702 | 0.3007 | GABARAPL1, PLCB1, ADCY2, GNG2 | 0.0122 |
| 181 | 0.1709 | 0.3007 | FGFR2, PDPK1 | 0.0042 |
| 182 | 0.1709 | 0.3007 | GLI3, SHH | 0.0042 |
| 183 | 0.1709 | 0.3007 | IL12B, CCL20 | 0.0042 |
| 184 | 0.1712 | 0.3007 | IL12B, IKBKE, IFNGR1, SRSF3, TAB2 | 0.0165 |
| 185 | 0.1718 | 0.3007 | PSMD6, GLI3, PSMB2 | 0.008 |
| 186 | 0.1718 | 0.3007 | COL9A1, CPB2, COL6A1 | 0.008 |
| 187 | 0.1718 | 0.3007 | ATP6V1E2, TLR4, CCL20 | 0.008 |
| 188 | 0.1718 | 0.3007 | PLCB1, ADCY2, GUCY1A2 | 0.008 |
| 189 | 0.173 | 0.3007 | ADAM10 | 0.0011 |
| 190 | 0.173 | 0.3007 | CDK6 | 0.0011 |
| 191 | 0.173 | 0.3007 | INHBA | 0.0011 |
| 192 | 0.173 | 0.3007 | FYB1 | 0.0011 |
| 193 | 0.1765 | 0.3007 | UXS1, PGM2 | 0.0043 |
| 194 | 0.1765 | 0.3007 | RIN2, ADAM10 | 0.0043 |
| 195 | 0.1795 | 0.3007 | SDC1, GSTO2, GSTO1, SUMO4 | 0.0124 |
| 196 | 0.1822 | 0.3007 | HBP1, SHH | 0.0044 |
| 197 | 0.1835 | 0.3007 | IKBKE, CCL20, TAB2 | 0.0083 |
| 198 | 0.186 | 0.3007 | GNG2 | 0.0012 |
| 199 | 0.186 | 0.3007 | CPB2 | 0.0012 |
| 200 | 0.186 | 0.3007 | ATP6AP2 | 0.0012 |
| 201 | 0.186 | 0.3007 | GNG2 | 0.0012 |
| 202 | 0.186 | 0.3007 | INHBA | 0.0012 |
| 203 | 0.186 | 0.3007 | GNG2 | 0.0012 |
| 204 | 0.186 | 0.3007 | IL12B | 0.0012 |
| 205 | 0.1878 | 0.3007 | CYP1B1, ADCY2 | 0.0045 |
| 206 | 0.1878 | 0.3007 | DLG2, NLGN4Y | 0.0045 |
| 207 | 0.1914 | 0.3007 | TLR4, LY96, TAB2 | 0.0085 |
| 208 | 0.1921 | 0.3007 | IKBKE, TLR4, LY96, TAB2 | 0.0128 |
| 209 | 0.1935 | 0.3007 | FGFR2, PDPK1 | 0.0046 |
| 210 | 0.1954 | 0.3007 | PLCB1, ADCY2, CPB2 | 0.0086 |
| 211 | 0.1985 | 0.3007 | ATP6V1E2, NEDD4L, SGK1, UNC80 | 0.013 |
| 212 | 0.1988 | 0.3007 | ACOX2 | 0.0013 |
| 213 | 0.1988 | 0.3007 | UCK1 | 0.0013 |
| 214 | 0.1993 | 0.3007 | AKAP5, FKBP1A | 0.0046 |
| 215 | 0.1993 | 0.3007 | SPRED2, PDPK1 | 0.0046 |
| 216 | 0.1993 | 0.3007 | SHH, WNT2 | 0.0046 |
| 217 | 0.2034 | 0.3007 | PSMD6, PSMB2, RFC3 | 0.0088 |
| 218 | 0.205 | 0.3007 | PSMD6, PSMB2 | 0.0047 |
| 219 | 0.205 | 0.3007 | ADCY2, OPRM1, SSTR1, GNG2 | 0.0131 |
| 220 | 0.2107 | 0.3007 | GSTO2, GSTO1 | 0.0048 |

TABLE 6.c1

| GeneSet | No_in_Gene_Set | In_List |
|---|---|---|
| 221 ErbB receptor signaling network(N) | 15 | 1 |
| 222 Prolactin receptor signaling(R) | 15 | 1 |
| 223 RAB geranylgeranylation(R) | 15 | 1 |
| 224 Glycosphingolipid biosynthesis - ganglio series(K) | 15 | 1 |
| 225 Interferon-gamma signaling pathway(P) | 15 | 1 |
| 226 Mismatch Repair(R) | 15 | 1 |
| 227 PAR4-mediated thrombin signaling events(N) | 15 | 1 |
| 228 Adrenergic signaling in cardiomyocytes(K) | 149 | 4 |
| 229 ErbB1 downstream signaling(N) | 100 | 3 |
| 230 Signaling by ROBO receptors(R) | 201 | 5 |
| 231 Retrograde endocannabinoid signaling(K) | 101 | 3 |
| 232 Pathogenic Escherichia coli infection(K) | 55 | 2 |
| 233 Legionellosis(K) | 55 | 2 |
| 234 Class A/1 (Rhodopsin-like receptors)(R) | 308 | 7 |
| 235 Non-small cell lung cancer(K) | 56 | 2 |
| 236 NCAM signaling for neurite out-growth(R) | 56 | 2 |
| 237 Rap1 signalling(R) | 16 | 1 |
| 238 LPA4-mediated signaling events(N) | 16 | 1 |
| 239 y branching of actin filaments(B) | 16 | 1 |
| 240 akt signaling pathway(B) | 16 | 1 |
| 241 role of pi3k subunit p85 in regulation of actin organization and cell migration(B) | 16 | 1 |
| 242 HIF-1 signaling pathway(K) | 103 | 3 |
| 243 Acute myeloid leukemia(K) | 57 | 2 |
| 244 Cellular senescence(K) | 154 | 4 |
| 245 T cell receptor signaling pathway(K) | 105 | 3 |
| 246 Syndecan-1-mediated signaling events(N) | 17 | 1 |
| 247 Thrombin signalling through proteinase | 17 | 1 |

TABLE 6.c1-continued

| GeneSet | No_in_Gene_Set | In_List |
|---|---|---|
| activated receptors (PARs)(R) | | |
| 248 prion pathway(B) | 17 | 1 |
| 249 Beta5 beta6 beta7 and beta8 integrin cell surface interactions(N) | 17 | 1 |
| 250 Primary bile acid biosynthesis(K) | 17 | 1 |
| 251 Signal amplification(R) | 17 | 1 |
| 252 Glycosaminoglycan metabolism(R) | 106 | 3 |
| 253 Platelet homeostasis(R) | 59 | 2 |
| 254 Lysine degradation(K) | 59 | 2 |
| 255 Phase II - Conjugation of compounds(R) | 59 | 2 |
| 256 Cytokine-cytokine receptor interaction(K) | 265 | 6 |
| 257 Long-term depression(K) | 60 | 2 |
| 258 G alpha (12/13) signalling events(R) | 60 | 2 |
| 259 internal ribosome entry pathway(B) | 18 | 1 |
| 260 Insulin resistance(K) | 109 | 3 |
| 261 Interleukin-4 and 13 signaling(R) | 110 | 3 |
| 262 TNF signaling pathway(K) | 110 | 3 |
| 263 Endothelins(N) | 62 | 2 |
| 264 Colorectal cancer(K) | 62 | 2 |
| 265 cyclins and cell cycle regulation(B) | 19 | 1 |
| 266 LPA receptor mediated events(N) | 63 | 2 |
| 267 Ras Pathway(P) | 63 | 2 |
| 268 IL4-mediated signaling events(N) | 64 | 2 |
| 269 Cytosolic DNA-sensing pathway(K) | 64 | 2 |
| 270 Glutamatergic synapse(K) | 114 | 3 |
| 271 Insulin processing(R) | 20 | 1 |
| 272 One carbon pool by folate(K) | 20 | 1 |
| 273 Synaptic adhesion-like molecules(R) | 20 | 1 |
| 274 Renin secretion(K) | 65 | 2 |
| 275 BCR signaling pathway(N) | 65 | 2 |
| 276 cGMP-PKG signaling pathway(K) | 168 | 4 |
| 277 Angiogenesis(P) | 66 | 2 |
| 278 cell cycle: g1/s check point(B) | 21 | 1 |
| 279 growth hormone signaling pathway(B) | 21 | 1 |
| 280 PDGFR-alpha signaling pathway(N) | 21 | 1 |
| 281 Notch signaling pathway(P) | 21 | 1 |
| 282 caspase cascade in apoptosis(B) | 21 | 1 |
| 283 Central carbon metabolism in cancer(K) | 67 | 2 |
| 284 TCR signaling in naïve CD4+ T cells(N) | 67 | 2 |
| 285 Renal cell carcinoma(K) | 67 | 2 |
| 286 Metabolism of polyamines(R) | 67 | 2 |
| 287 Glycolysis/Gluconeogenesis(K) | 67 | 2 |
| 288 Epithelial cell signaling in Helicobacter pylori infection(K) | 68 | 2 |
| 289 Glyoxylate metabolism and glycine degradation(R) | 22 | 1 |
| 290 Incretin synthesis, secretion, and inactivation(R) | 22 | 1 |
| 291 Deubiquitination(R) | 229 | 5 |
| 292 Vascular smooth muscle contraction(K) | 121 | 3 |
| 293 Influenza A(K) | 175 | 4 |
| 294 Purine metabolism(K) | 175 | 4 |
| 295 CDC42 signaling events(N) | 70 | 2 |
| 296 RIG-I-like receptor signaling pathway(K) | 70 | 2 |
| 297 Cell junction organization(R) | 70 | 2 |
| 298 Drug metabolism - cytochrome P450(K) | 70 | 2 |
| 299 Signaling by the B Cell Receptor (BCR)(R) | 176 | 4 |
| 300 Huntington disease(P) | 122 | 3 |
| 301 Signaling events mediated by the Hedgehog family(N) | 23 | 1 |
| 302 Renin-angiotensin system(K) | 23 | 1 |
| 303 regulation of eif-4e and p70s6 kinase(B) | 23 | 1 |
| 304 Melanoma(K) | 71 | 2 |
| 305 Tuberculosis(K) | 179 | 4 |
| 306 Adherens junction(K) | 72 | 2 |
| 307 mtor signaling pathway(B) | 24 | 1 |
| 308 Myogenesis(R) | 24 | 1 |
| 309 Growth hormone receptor signaling(R) | 24 | 1 |
| 310 Vitamin digestion and absorption(K) | 24 | 1 |
| 311 Histidine metabolism(K) | 24 | 1 |
| 312 Signaling by TGF-beta Receptor Complex(R) | 73 | 2 |
| 313 Interferon gamma signaling(R) | 73 | 2 |
| 314 Chronic myeloid leukemia(K) | 73 | 2 |
| 315 Regulation of Hypoxia-inducible Factor (HIF) by oxygen(R) | 73 | 2 |
| 316 RAB GEFs exchange GTP for GDP on RABs(R) | 73 | 2 |
| 317 Glycosylphosphatidylinositol (GPI)-anchor biosynthesis(K) | 25 | 1 |
| 318 Other interleukin signaling(R) | 25 | 1 |
| 319 Nongenotropic Androgen signaling(N) | 25 | 1 |
| 320 ras-independent pathway in nk cell-mediated cytotoxicity(B) | 25 | 1 |
| 321 Bile acid and bile salt metabolism(R) | 25 | 1 |
| 322 C-MYC pathway(N) | 25 | 1 |
| 323 Regulation of DNA replication(R) | 74 | 2 |

TABLE 6.c1-continued

| GeneSet | No_in_Gene_Set | In_List |
|---|---|---|
| 324 Metabolism of water-soluble vitamins and cofactors(R) | 74 | 2 |
| 325 RNA Polymerase II Transcription(R) | 826 | 15 |
| 326 Gastric acid secretion(K) | 75 | 2 |
| 327 p73 transcription factor network(N) | 75 | 2 |
| 328 WNT ligand biogenesis and trafficking(R) | 26 | 1 |
| 329 Vasopressin regulates renal water homeostasis via Aquaporins(R) | 26 | 1 |
| 330 PI3 kinase pathway(P) | 26 | 1 |

TABLE 6.c2

| | P-value | FDR | Nodes | RatioOf-ProteinInGeneSet |
|---|---|---|---|---|
| 221 | 0.2114 | 0.3007 | NRG3 | 0.0013 |
| 222 | 0.2114 | 0.3007 | GHR | 0.0013 |
| 223 | 0.2114 | 0.3007 | RAB38 | 0.0013 |
| 224 | 0.2114 | 0.3007 | ST6GALNAC3 | 0.0013 |
| 225 | 0.2114 | 0.3007 | IFNGR1 | 0.0013 |
| 226 | 0.2114 | 0.3007 | MSH2 | 0.0013 |
| 227 | 0.2114 | 0.3007 | GNG2 | 0.0013 |
| 228 | 0.2115 | 0.3007 | PLCB1, RAPGEF4, ADCY2, CREB5 | 0.0133 |
| 229 | 0.2116 | 0.3007 | RICTOR, ACTR2, PDPK1 | 0.0089 |
| 230 | 0.2145 | 0.3007 | PSMD6, AKAP5, PSMB2, SRGAP3, SRGAP2 | 0.018 |
| 231 | 0.2157 | 0.3007 | PLCB1, ADCY2, GNG2 | 0.009 |
| 232 | 0.2165 | 0.3007 | TLR4, LY96 | 0.0049 |
| 233 | 0.2165 | 0.3007 | IL12B, TLR4 | 0.0049 |
| 234 | 0.2173 | 0.3007 | GPR183, GPR18, OXGR1, CCL20, OPRM1, SSTR1, CX3CR1 | 0.0275 |
| 235 | 0.2223 | 0.3007 | CDK6, PDPK1 | 0.005 |
| 236 | 0.2223 | 0.3007 | COL9A1, COL6A1 | 0.005 |
| 237 | 0.2238 | 0.3007 | RAPGEF4 | 0.0014 |
| 238 | 0.2238 | 0.3007 | ADCY2 | 0.0014 |
| 239 | 0.2238 | 0.3007 | ACTR2 | 0.0014 |
| 240 | 0.2238 | 0.3007 | GHR | 0.0014 |
| 241 | 0.2238 | 0.3007 | ACTR2 | 0.0014 |
| 242 | 0.2239 | 0.3007 | PDK1, IFNGR1, TLR4 | 0.0092 |
| 243 | 0.2281 | 0.3007 | CCNA1, TCF7L2 | 0.0051 |
| 244 | 0.2281 | 0.3007 | CHEK2, CCNB2, CDK6, CCNA1 | 0.0138 |
| 245 | 0.2322 | 0.3007 | CBLB, PAK3, PDPK1 | 0.0094 |
| 246 | 0.236 | 0.3007 | SDC1 | 0.0015 |
| 247 | 0.236 | 0.3007 | GNG2 | 0.0015 |
| 248 | 0.236 | 0.3007 | LAMA3 | 0.0015 |
| 249 | 0.236 | 0.3007 | SDC1 | 0.0015 |
| 250 | 0.236 | 0.3007 | ACOX2 | 0.0015 |
| 251 | 0.236 | 0.3007 | GNG2 | 0.0015 |
| 252 | 0.2363 | 0.3007 | OMD, SDC1, OGN | 0.0095 |
| 253 | 0.2397 | 0.3007 | GUCY1A2, GNG2 | 0.0053 |
| 254 | 0.2397 | 0.3007 | DLST, PRDM2 | 0.0053 |
| 255 | 0.2397 | 0.3007 | GSTO2, GSTO1 | 0.0053 |
| 256 | 0.2441 | 0.3007 | IL12B, IFNGR1, CCL20, INHBA, GHR, CX3CR1 | 0.0237 |
| 257 | 0.2456 | 0.3007 | PLCB1, GUCY1A2 | 0.0054 |
| 258 | 0.2456 | 0.3007 | ARHGEF7, GNG2 | 0.0054 |
| 259 | 0.248 | 0.3007 | CASP4 | 0.0016 |
| 260 | 0.2489 | 0.3007 | PPP1R3D, PDPK1, CREB5 | 0.0097 |
| 261 | 0.2531 | 0.3007 | IL12B, OPRM1, IRF4 | 0.0098 |
| 262 | 0.2531 | 0.3007 | CCL20, TAB2, CREB5 | 0.0098 |
| 263 | 0.2572 | 0.3007 | PLCB1, ADCY2 | 0.0055 |
| 264 | 0.2572 | 0.3007 | MSH2, TCF7L2 | 0.0055 |
| 265 | 0.2598 | 0.3007 | CCNA1 | 0.0017 |
| 266 | 0.2631 | 0.3007 | ADCY2, GNG2 | 0.0056 |
| 267 | 0.2631 | 0.3007 | PAK3, PDPK1 | 0.0056 |
| 268 | 0.2689 | 0.3007 | OPRM1, IRF4 | 0.0057 |
| 269 | 0.2689 | 0.3007 | IKBKE, AIM2 | 0.0057 |
| 270 | 0.2701 | 0.3007 | PLCB1, ADCY2, GNG2 | 0.0102 |
| 271 | 0.2715 | 0.3007 | EXOC2 | 0.0018 |
| 272 | 0.2715 | 0.3007 | MTHFD1 | 0.0018 |
| 273 | 0.2715 | 0.3007 | LRFN2 | 0.0018 |
| 274 | 0.2747 | 0.3007 | PLCB1, GUCY1A2 | 0.0058 |
| 275 | 0.2747 | 0.3007 | IBTK, PDPK1 | 0.0058 |
| 276 | 0.2761 | 0.3007 | PLCB1, ADCY2, GUCY1A2, CREB5 | 0.015 |
| 277 | 0.2806 | 0.3007 | FZD3, TCF7L2 | 0.0059 |
| 278 | 0.2829 | 0.3007 | CCNA1 | 0.0019 |
| 279 | 0.2829 | 0.3007 | GHR | 0.0019 |

TABLE 6.c2-continued

| | P-value | FDR | Nodes | RatioOf-ProteinInGeneSet |
|---|---|---|---|---|
| 280 | 0.2829 | 0.3007 | RAPGEF1 | 0.0019 |
| 281 | 0.2829 | 0.3007 | ADAM10 | 0.0019 |
| 282 | 0.2829 | 0.3007 | CASP4 | 0.0019 |
| 283 | 0.2864 | 0.3007 | PDK1, FGFR2 | 0.006 |
| 284 | 0.2864 | 0.3007 | FYB1, PDPK1 | 0.006 |
| 285 | 0.2864 | 0.3007 | RAPGEF1, PAK3 | 0.006 |
| 286 | 0.2864 | 0.3007 | PSMD6, PSMB2 | 0.006 |
| 287 | 0.2864 | 0.3007 | LDHAL6B, PGM2 | 0.006 |
| 288 | 0.2922 | 0.3007 | ATP6V1E2, ADAM10 | 0.0061 |
| 289 | 0.2942 | 0.3007 | DLST | 0.002 |
| 290 | 0.2942 | 0.3007 | TCF7L2 | 0.002 |
| 291 | 0.2972 | 0.3007 | PSMD6, PSMB2, INO80C, CLSPN, CCNA1 | 0.0205 |
| 292 | 0.3001 | 0.3007 | PLCB1, ADCY2, GUCY1A2 | 0.0108 |
| 293 | 0.300 | 0.3007 | IL12B, IKBKE, IFNGR1, TLR4 | 0.0156 |
| 294 | 0.300 | 0.3007 | ADCY2, GUCY1A2, PDE4B, PGM2 | 0.0156 |
| 295 | 0.3039 | 0.3039 | ARHGEF7, ACTR2 | 0.0063 |
| 296 | 0.3039 | 0.3039 | IL12B, IKBKE | 0.0063 |
| 297 | 0.3039 | 0.3039 | CDH17, LAMA3 | 0.0063 |
| 298 | 0.3039 | 0.3039 | GSTO2, GSTO1 | 0.0063 |
| 299 | 0.3043 | 0.3043 | CBLB, PSMD6, PSMB2, FKBP1A | 0.0157 |
| 300 | 0.3044 | 0.3044 | RHOQ, CAPN6, ACTR2 | 0.0109 |
| 301 | 0.3053 | 0.3053 | SHH | 0.0021 |
| 302 | 0.3053 | 0.3053 | ATP6AP2 | 0.0021 |
| 303 | 0.3053 | 0.3053 | GHR | 0.0021 |
| 304 | 0.3097 | 0.3097 | CDK6, FGF12 | 0.0063 |
| 305 | 0.3149 | 0.3149 | IL12B, IFNGR1, TLR4, CLEC7A | 0.016 |
| 306 | 0.3155 | 0.3155 | CTNNA2, TCF7L2 | 0.0064 |
| 307 | 0.3162 | 0.3162 | GHR | 0.0021 |
| 308 | 0.3162 | 0.3162 | CTNNA2 | 0.0021 |
| 309 | 0.3162 | 0.3162 | GHR | 0.0021 |
| 310 | 0.3162 | 0.3162 | SLC19A3 | 0.0021 |
| 311 | 0.3162 | 0.3162 | HNMT | 0.0021 |
| 312 | 0.3212 | 0.3212 | NEDD4L, FKBP1A | 0.0065 |
| 313 | 0.3212 | 0.3212 | IFNGR1, IRF4 | 0.0065 |
| 314 | 0.3212 | 0.3212 | CBLB, CDK6 | 0.0065 |
| 315 | 0.3212 | 0.3212 | PSMD6, PSMB2 | 0.0065 |
| 316 | 0.3212 | 0.3212 | RIN2, RAB38 | 0.0065 |
| 317 | 0.327 | 0.327 | PIGF | 0.0022 |
| 318 | 0.327 | 0.327 | SDC1 | 0.0022 |
| 319 | 0.327 | 0.327 | GNG2 | 0.0022 |
| 320 | 0.327 | 0.327 | KLRD1 | 0.0022 |
| 321 | 0.327 | 0.327 | ACOX2 | 0.0022 |
| 322 | 0.327 | 0.327 | HBP1 | 0.0022 |
| 323 | 0.327 | 0.327 | PSMD6, PSMB2 | 0.0066 |
| 324 | 0.327 | 0.327 | MTHFD1, GSTO2 | 0.0066 |
| 325 | 0.3281 | 0.3281 | PSMD6, CHEK2, NEDD4L, INTS6, GLI3, SGK1, PSMB2, RICTOR, KCTD6, MSH2, SRSF3, CDK6, RFC3, PDPK1, TCF7L2 | 0.0738 |
| 326 | 0.3328 | 0.3328 | PLCB1, ADCY2 | 0.0067 |
| 327 | 0.3328 | 0.3328 | NEDD4L, CDK6 | 0.0067 |
| 328 | 0.3376 | 0.3376 | WNT2 | 0.0023 |
| 329 | 0.3376 | 0.3376 | ADCY2 | 0.0023 |
| 330 | 0.3376 | 0.3376 | PDPK1 | 0.0023 |

TABLE 6.d1

| | GeneSet | No_in_Gene_Set | In_List |
|---|---|---|---|
| 331 | IL27-mediated signaling events(N) | 26 | 1 |
| 332 | Glycerophospholipid biosynthesis(R) | 76 | 2 |
| 333 | Dopaminergic synapse(K) | 130 | 3 |
| 334 | p38 MAPK signaling pathway(N) | 27 | 1 |
| 335 | Insulin-mediated glucose transport(N) | 27 | 1 |
| 336 | Glycogen metabolism(R) | 27 | 1 |
| 337 | Collecting duct acid secretion(K) | 27 | 1 |
| 338 | DDX58/IFIH1-mediated induction of interferon-alpha/beta(R) | 79 | 2 |
| 339 | Regulation of nuclear beta catenin signaling and target gene transcription(N) | 79 | 2 |
| 340 | S Phase(R) | 134 | 3 |
| 341 | Heterotrimeric G-protein signaling pathway-rod outer segment phototransduction(P) | 28 | 1 |
| 342 | Reelin signaling pathway(N) | 28 | 1 |
| 343 | IL2 signaling events mediated by STAT5(N) | 28 | 1 |

TABLE 6.d1-continued

| | GeneSet | No_in_Gene_Set | In_List |
|---|---|---|---|
| 344 | Dorso-ventral axis formation(K) | 28 | 1 |
| 345 | ErbB4 signaling events(N) | 28 | 1 |
| 346 | Signaling by NOTCH2(R) | 29 | 1 |
| 347 | Nucleosome assembly(R) | 29 | 1 |
| 348 | Thyroid cancer(K) | 29 | 1 |
| 349 | Hippo signaling pathway - multiple species(K) | 29 | 1 |
| 350 | CD40/CD40L signaling(N) | 29 | 1 |
| 351 | Tight junction(K) | 137 | 3 |
| 352 | Interleukin-1 family signaling(R) | 137 | 3 |
| 353 | MAPK signaling pathway(K) | 255 | 5 |
| 354 | Regulation of mitotic cell cycle(R) | 83 | 2 |
| 355 | Pentose phosphate pathway(K) | 30 | 1 |
| 356 | Regulation of CDC42 activity(N) | 30 | 1 |
| 357 | IGF1 pathway(N) | 30 | 1 |
| 358 | Nectin adhesion pathway(N) | 30 | 1 |
| 359 | Alpha-synuclein signaling(N) | 30 | 1 |
| 360 | Resolution of Abasic Sites (AP sites)(R) | 31 | 1 |
| 361 | Regulation of p38-alpha and p38-beta(N) | 31 | 1 |
| 362 | Aurora A signaling(N) | 31 | 1 |
| 363 | Galactose metabolism(K) | 31 | 1 |
| 364 | Mucin type O-glycan biosynthesis(K) | 31 | 1 |
| 365 | trefoil factors initiate mucosal healing(B) | 31 | 1 |
| 366 | M/G1 Transition(R) | 85 | 2 |
| 367 | Salmonella infection(K) | 86 | 2 |
| 368 | Syndecan-4-mediated signaling events(N) | 32 | 1 |
| 369 | ROS, RNS production in phagocytes(R) | 32 | 1 |
| 370 | FAS (CD95) signaling pathway(N) | 32 | 1 |
| 371 | Netrin-mediated signaling events(N) | 32 | 1 |
| 372 | DAG and IP3 signaling(R) | 32 | 1 |
| 373 | toll-like receptor pathway(B) | 32 | 1 |
| 374 | Syndecan-2-mediated signaling events(N) | 32 | 1 |
| 375 | Noncanonical Wnt signaling pathway(N) | 32 | 1 |
| 376 | Phospholipase D signaling pathway(K) | 144 | 3 |
| 377 | Regulation of mRNA stability by proteins that bind AU-rich elements(R) | 87 | 2 |
| 378 | Viral carcinogenesis(K) | 203 | 4 |
| 379 | Epstein-Barr virus infection(K) | 204 | 4 |
| 380 | Alpha4 beta1 integrin signaling events(N) | 33 | 1 |
| 381 | Oncogene Induced Senescence(R) | 33 | 1 |
| 382 | actions of nitric oxide in the heart(B) | 33 | 1 |
| 383 | EPO signaling pathway(N) | 33 | 1 |
| 384 | Intra-Golgi and retrograde Golgi-to-ER traffic(R) | 147 | 3 |
| 385 | ABC-family proteins mediated transport(R) | 89 | 2 |
| 386 | Arf6 trafficking events(N) | 34 | 1 |
| 387 | IL1-mediated signaling events(N) | 34 | 1 |
| 388 | ATM pathway(N) | 34 | 1 |
| 389 | Dilated cardiomyopathy(K) | 90 | 2 |
| 390 | Cell surface interactions at the vascular wall(R) | 208 | 4 |
| 391 | Fc epsilon receptor (FCERI) signaling(R) | 209 | 4 |
| 392 | Arf6 signaling events(N) | 35 | 1 |
| 393 | Signaling mediated by p38-alpha and p38-beta(N) | 35 | 1 |
| 394 | FGF signaling pathway(P) | 92 | 2 |
| 395 | Th1 and Th2 cell differentiation(K) | 92 | 2 |
| 396 | GnRH signaling pathway(K) | 92 | 2 |
| 397 | Trk receptor signaling mediated by PI3K and PLC-gamma(N) | 36 | 1 |
| 398 | DNA replication(K) | 36 | 1 |
| 399 | Starch and sucrose metabolism(K) | 36 | 1 |
| 400 | inactivation of gsk3 by akt causes accumulation of b-catenin in alveolar macrophages(B) | 36 | 1 |
| 401 | Meiotic synapsis(R) | 36 | 1 |
| 402 | Signaling by Retinoic Acid(R) | 36 | 1 |
| 403 | E-cadherin signaling in the nascent adherens junction(N) | 36 | 1 |
| 404 | Longevity regulating pathway(K) | 94 | 2 |
| 405 | Regulation of actin cytoskeleton(K) | 214 | 4 |
| 406 | Validated transcriptional targets of AP1 family members Fra1 and Fra2(N) | 37 | 1 |
| 407 | IL23-mediated signaling events(N) | 37 | 1 |
| 408 | Arachidonic acid metabolism(R) | 37 | 1 |
| 409 | TNF signaling(R) | 38 | 1 |
| 410 | Retinoid metabolism and transport(R) | 38 | 1 |
| 411 | Allograft rejection(K) | 38 | 1 |
| 412 | Interleukin-3, 5 and GM-CSF signaling(R) | 38 | 1 |
| 413 | Transport of bile salts and organic acids, metal ions and amine compounds(R) | 38 | 1 |
| 414 | Signaling events mediated by HDAC Class II(N) | 38 | 1 |
| 415 | Inositol phosphate metabolism(R) | 38 | 1 |

TABLE 6.d1-continued

| | GeneSet | No_in_Gene_Set | In_List |
|---|---|---|---|
| 416 | Telomere Maintenance(R) | 38 | 1 |
| 417 | Jak-STAT signaling pathway(K) | 158 | 3 |
| 418 | Pyruvate metabolism(K) | 39 | 1 |
| 419 | Oxytocin signaling pathway(K) | 159 | 3 |
| 420 | Phosphatidylinositol signaling system(K) | 99 | 2 |
| 421 | Inflammatory mediator regulation of TRP channels(K) | 99 | 2 |
| 422 | TCF dependent signaling in response to WNT(R) | 160 | 3 |
| 423 | Tryptophan metabolism(K) | 40 | 1 |
| 424 | Neurotransmitter release cycle(R) | 40 | 1 |
| 425 | Autophagy(K) | 40 | 1 |
| 426 | TNFR2 non-canonical NF-KB pathway(R) | 101 | 2 |
| 427 | Choline metabolism in cancer(K) | 101 | 2 |
| 428 | BMP receptor signaling(N) | 41 | 1 |
| 429 | Graft-versus-host disease(K) | 41 | 1 |
| 430 | Homologous recombination(K) | 41 | 1 |
| 431 | Nucleotide Excision Repair(R) | 102 | 2 |
| 432 | ion channels and their functional role in vascular endothelium(B) | 42 | 1 |
| 433 | Porphyrin and chlorophyll metabolism(K) | 42 | 1 |
| 434 | Type I diabetes mellitus(K) | 43 | 1 |
| 435 | Signaling by ERBB4(R) | 43 | 1 |
| 436 | Signaling by NOTCH3(R) | 43 | 1 |
| 437 | LKB1 signaling events(N) | 43 | 1 |

TABLE 6.d2

| | P-value | FDR | Nodes | RatioOf-ProteinInGeneSet |
|---|---|---|---|---|
| 331 | 0.3376 | 0.3376 | IL12B | 0.0023 |
| 332 | 0.3385 | 0.3385 | CDS1, SLC44A1 | 0.0068 |
| 333 | 0.3388 | 0.3388 | PLCB1, CREB5, GNG2 | 0.0116 |
| 334 | 0.348 | 0.348 | TAB2 | 0.0024 |
| 335 | 0.348 | 0.348 | RHOQ | 0.0024 |
| 336 | 0.348 | 0.348 | PGM2 | 0.0024 |
| 337 | 0.348 | 0.348 | ATP6V1E2 | 0.0024 |
| 338 | 0.3557 | 0.3557 | HERC5, IKBKE | 0.0071 |
| 339 | 0.3557 | 0.3557 | HBP1, TCF7L2 | 0.0071 |
| 340 | 0.356 | 0.356 | PSMD6, PSMB2, RFC3 | 0.012 |
| 341 | 0.3583 | 0.3583 | GNG2 | 0.0025 |
| 342 | 0.3583 | 0.3583 | RAPGEF1 | 0.0025 |
| 343 | 0.3583 | 0.3583 | CDK6 | 0.0025 |
| 344 | 0.3583 | 0.3583 | CPEB4 | 0.0025 |
| 345 | 0.3583 | 0.3583 | TAB2 | 0.0025 |
| 346 | 0.3684 | 0.3684 | ADAM10 | 0.0026 |
| 347 | 0.3684 | 0.3684 | CENPP | 0.0026 |
| 348 | 0.3684 | 0.3684 | TCF7L2 | 0.0026 |
| 349 | 0.3684 | 0.3684 | FAT4 | 0.0026 |
| 350 | 0.3684 | 0.3684 | CBLB | 0.0026 |
| 351 | 0.3689 | 0.3689 | CTNNA2, MAGI1, VAPA | 0.0122 |
| 352 | 0.3689 | 0.3689 | PSMD6, PSMB2, TAB2 | 0.0122 |
| 353 | 0.378 | 0.378 | PPP5D1, MAP4K3, TAB2, FGF12, FGFR2 | 0.0228 |
| 354 | 0.3783 | 0.3783 | PSMD6, PSMB2 | 0.0074 |
| 355 | 0.3783 | 0.3783 | PGM2 | 0.0027 |
| 356 | 0.3783 | 0.3783 | ARHGEF7 | 0.0027 |
| 357 | 0.3783 | 0.3783 | PDPK1 | 0.0027 |
| 358 | 0.3783 | 0.3783 | RAPGEF1 | 0.0027 |
| 359 | 0.3783 | 0.3783 | FKBP1A | 0.0027 |
| 360 | 0.3881 | 0.3881 | RFC3 | 0.0028 |
| 361 | 0.3881 | 0.3881 | PAK3 | 0.0028 |
| 362 | 0.3881 | 0.3881 | ARHGEF7 | 0.0028 |
| 363 | 0.3881 | 0.3881 | PGM2 | 0.0028 |
| 364 | 0.3881 | 0.3881 | GALNT1 | 0.0028 |
| 365 | 0.3881 | 0.3881 | GHR | 0.0028 |
| 366 | 0.3894 | 0.3894 | PSMD6, PSMB2 | 0.0076 |
| 367 | 0.395 | 0.395 | IFNGR1, TLR4 | 0.0077 |
| 368 | 0.3977 | 0.3977 | LAMA3 | 0.0029 |
| 369 | 0.3977 | 0.3977 | ATP6V1E2 | 0.0029 |
| 370 | 0.3977 | 0.3977 | PDPK1 | 0.0029 |
| 371 | 0.3977 | 0.3977 | ELMO1 | 0.0029 |
| 372 | 0.3977 | 0.3977 | ADCY2 | 0.0029 |
| 373 | 0.3977 | 0.3977 | LY96 | 0.0029 |
| 374 | 0.3977 | 0.3977 | LAMA3 | 0.0029 |
| 375 | 0.3977 | 0.3977 | TAB2 | 0.0029 |

TABLE 6.d2-continued

| | P-value | FDR | Nodes | RatioOf-ProteinInGeneSet |
|---|---|---|---|---|
| 376 | 0.3987 | 0.3987 | PLCB1, RAPGEF4, ADCY2 | 0.0129 |
| 377 | 0.4005 | 0.4005 | PSMD6, PSMB2 | 0.0078 |
| 378 | 0.4005 | 0.4005 | EGR3, CDK6, CCNA1, CREB5 | 0.0181 |
| 379 | 0.4041 | 0.4041 | PSMD6, CD58, TAB2, CCNA1 | 0.0182 |
| 380 | 0.4072 | 0.4072 | THBS2 | 0.0029 |
| 381 | 0.4072 | 0.4072 | CDK6 | 0.0029 |
| 382 | 0.4072 | 0.4072 | GUCY1A2 | 0.0029 |
| 383 | 0.4072 | 0.4072 | RAPGEF1 | 0.0029 |
| 384 | 0.4114 | 0.4114 | COG5, VTI1A, GALNT1 | 0.0131 |
| 385 | 0.4115 | 0.4115 | PSMD6, PSMB2 | 0.008 |
| 386 | 0.4165 | 0.4165 | EXOC2 | 0.003 |
| 387 | 0.4165 | 0.4165 | TAB2 | 0.003 |
| 388 | 0.4165 | 0.4165 | CHEK2 | 0.003 |
| 389 | 0.417 | 0.417 | ADCY2, SGCG | 0.008 |
| 390 | 0.4183 | 0.4183 | SDC1, OLR1, EPCAM, CD58 | 0.0186 |
| 391 | 0.4218 | 0.4218 | PSMD6, PSMB2, TAB2, PDPK1 | 0.0187 |
| 392 | 0.4257 | 0.4257 | IPCEF1 | 0.0031 |
| 393 | 0.4257 | 0.4257 | HBP1 | 0.0031 |
| 394 | 0.4279 | 0.4279 | FGF12, FGFR2 | 0.0082 |
| 395 | 0.4279 | 0.4279 | IL12B, IFNGR1 | 0.0082 |
| 396 | 0.4279 | 0.4279 | PLCB1, ADCY2 | 0.0082 |
| 397 | 0.4348 | 0.4348 | PDPK1 | 0.0032 |
| 398 | 0.4348 | 0.4348 | RFC3 | 0.0032 |
| 399 | 0.4348 | 0.4348 | PGM2 | 0.0032 |
| 400 | 0.4348 | 0.4348 | LY96 | 0.0032 |
| 401 | 0.4348 | 0.4348 | SYCP2 | 0.0032 |
| 402 | 0.4348 | 0.4348 | PDK1 | 0.0032 |
| 403 | 0.4348 | 0.4348 | RAPGEF1 | 0.0032 |
| 404 | 0.4386 | 0.4386 | ADCY2, CREB5 | 0.0084 |
| 405 | 0.4394 | 0.4394 | ARHGEF7, PAK3, FGF12, FGFR2 | 0.0191 |
| 406 | 0.4437 | 0.4437 | LAMA3 | 0.0033 |
| 407 | 0.4437 | 0.4437 | IL12B | 0.0033 |
| 408 | 0.4437 | 0.4437 | CYP1B1 | 0.0033 |
| 409 | 0.4524 | 0.4524 | TAB2 | 0.0034 |
| 410 | 0.4524 | 0.4524 | SDC1 | 0.0034 |
| 411 | 0.4524 | 0.4524 | IL12B | 0.0034 |
| 412 | 0.4524 | 0.4524 | RAPGEF1 | 0.0034 |
| 413 | 0.4524 | 0.4524 | SLC44A1 | 0.0034 |
| 414 | 0.4524 | 0.4524 | GNG2 | 0.0034 |
| 415 | 0.4524 | 0.4524 | PLCB1 | 0.0034 |
| 416 | 0.4524 | 0.4524 | RFC3 | 0.0034 |
| 417 | 0.4571 | 0.4571 | IL12B, IFNGR1, GHR | 0.0141 |
| 418 | 0.4611 | 0.4611 | LDHAL6B | 0.0035 |
| 419 | 0.4611 | 0.4611 | PLCB1, ADCY2, GUCY1A2 | 0.0142 |
| 420 | 0.465 | 0.465 | CDS1, PLCB1 | 0.0088 |
| 421 | 0.465 | 0.465 | PLCB1, ADCY2 | 0.0088 |
| 422 | 0.4652 | 0.4652 | PSMD6, PSMB2, TCF7L2 | 0.0143 |
| 423 | 0.4695 | 0.4695 | CYP1B1 | 0.0036 |
| 424 | 0.4695 | 0.4695 | ARL6IP5 | 0.0036 |
| 425 | 0.4695 | 0.4695 | GABARAPL1 | 0.0036 |
| 426 | 0.4753 | 0.4753 | PSMD6, PSMB2 | 0.009 |
| 427 | 0.4753 | 0.4753 | SLC44A1, PDPK1 | 0.009 |
| 428 | 0.4779 | 0.4779 | TAB2 | 0.0037 |
| 429 | 0.4779 | 0.4779 | KLRD1 | 0.0037 |
| 430 | 0.4779 | 0.4779 | RAD51B | 0.0037 |
| 431 | 0.4804 | 0.4804 | INO80C, RFC3 | 0.0091 |
| 432 | 0.4861 | 0.4861 | GUCY1A2 | 0.0038 |
| 433 | 0.4861 | 0.4861 | MMAB | 0.0038 |
| 434 | 0.4942 | 0.4942 | IL12B | 0.0038 |
| 435 | 0.4942 | 0.4942 | TAB2 | 0.0038 |
| 436 | 0.4942 | 0.4942 | ADAM10 | 0.0038 |
| 437 | 0.4942 | 0.4942 | MAP2 | 0.0038 |

TABLE 7.a1

| | GeneSet | No_Gene_Set | From_list | P-value |
|---|---|---|---|---|
| 1 | ras-independent pathway in nk cell-mediated cytotoxicity(B) | 25 | 5 | 0.0000286 |
| 2 | Jak-STAT signaling pathway(K) | 158 | 10 | 0.0000766 |
| 3 | Natural killer cell mediated cytotoxicity(K) | 135 | 9 | 0.000120 |
| 4 | Aldosterone-regulated sodium reabsorption(K) | 39 | 5 | 0.000226 |
| 5 | DAP12 interactions(R) | 44 | 5 | 0.000391 |

TABLE 7.a1-continued

| GeneSet | No_Gene_Set | From_list | P-value |
|---|---|---|---|
| 6 Oxytocin signaling pathway(K) | 159 | 9 | 0.000395 |
| 7 Signaling events mediated by Hepatocyte Growth Factor Receptor (c-Met)(N) | 80 | 6 | 0.000912 |
| 8 Cytokine-cytokine receptor interaction(K) | 265 | 11 | 0.00119 |
| 9 mTOR signaling pathway(K) | 154 | 8 | 0.00143 |
| 10 Signaling mediated by p38-alpha and p38-beta(N) | 35 | 4 | 0.00149 |
| 11 MAPK signaling pathway(K) | 255 | 10 | 0.00298 |
| 12 Metabotropic glutamate receptor group III pathway(P) | 6 | 2 | 0.00321 |
| 13 Pathways in cancer(K) | 397 | 13 | 0.00353 |
| 14 Signaling pathways regulating pluripotency of stem cells(K) | 142 | 7 | 0.00374 |
| 15 Interleukin-6 family signaling(R) | 23 | 3 | 0.00412 |
| 16 Ion channel transport(R) | 145 | 7 | 0.00418 |
| 17 Presynaptic depolarization and calcium channel opening(R) | 7 | 2 | 0.00433 |
| 18 Antigen processing and presentation(K) | 77 | 5 | 0.00448 |
| 19 Ovarian steroidogenesis(K) | 50 | 4 | 0.00529 |
| 20 Calcium signaling in the CD4+ TCR pathway(N) | 27 | 3 | 0.00640 |
| 21 Small cell lung cancer(K) | 86 | 5 | 0.00706 |
| 22 Salmonella infection(K) | 86 | 5 | 0.00706 |
| 23 Reelin signaling pathway(N) | 28 | 3 | 0.00707 |
| 24 Huntington disease(P) | 122 | 6 | 0.00719 |
| 25 Osteopontin-mediated events(N) | 29 | 3 | 0.00777 |
| 26 Regulation of lipolysis in adipocytes(K) | 56 | 4 | 0.00781 |
| 27 Signaling events mediated by focal adhesion kinase(N) | 60 | 4 | 0.00987 |
| 28 Signaling by VEGF(R) | 94 | 5 | 0.0101 |
| 29 VEGF signaling pathway(K) | 61 | 4 | 0.0104 |
| 30 IL4-mediated signaling events(N) | 64 | 4 | 0.0123 |
| 31 mTOR signaling pathway(N) | 64 | 4 | 0.0123 |
| 32 Kaposi's sarcoma-associated herpesvirus infection(K) | 180 | 7 | 0.0128 |
| 33 BCR signaling pathway(N) | 65 | 4 | 0.0129 |
| 34 ErbB1 downstream signaling(N) | 100 | 5 | 0.0129 |
| 35 Fluid shear stress and atherosclerosis(K) | 139 | 6 | 0.013 |
| 36 Calcium signaling pathway(K) | 182 | 7 | 0.0135 |
| 37 Angiogenesis(P) | 66 | 4 | 0.0136 |
| 38 E-cadherin signaling in the nascent adherens junction(N) | 36 | 3 | 0.0139 |
| 39 Arachidonic acid metabolism(R) | 37 | 3 | 0.0149 |
| 40 T cell receptor signaling pathway(K) | 105 | 5 | 0.0156 |
| 41 Toll-like receptor signaling pathway(K) | 106 | 5 | 0.0162 |
| 42 JNK signaling in the CD4+ TCR pathway(N) | 14 | 2 | 0.0163 |
| 43 Th17 cell differentiation(K) | 107 | 5 | 0.0168 |
| 44 IFN-gamma pathway(N) | 40 | 3 | 0.0183 |
| 45 Oxidative stress response(P) | 40 | 3 | 0.0183 |
| 46 Interleukin-4 and 13 signaling(R) | 110 | 5 | 0.0187 |
| 47 TNF signaling pathway(K) | 110 | 5 | 0.0187 |
| 48 B cell receptor signaling pathway(K) | 73 | 4 | 0.0189 |
| 49 nerve growth factor pathway (ngf)(B) | 16 | 2 | 0.0209 |
| 50 Thiamine metabolism(K) | 16 | 2 | 0.0209 |
| 51 Glutamatergic synapse(K) | 114 | 5 | 0.0214 |
| 52 cAMP signaling pathway(K) | 200 | 7 | 0.0214 |
| 53 Focal adhesion(K) | 201 | 7 | 0.022 |
| 54 control of skeletal myogenesis by hdac and calcium/calmodulin-dependent kinase (camk)(B) | 17 | 2 | 0.0234 |
| 55 Integrin-linked kinase signaling(N) | 45 | 3 | 0.0248 |
| 56 Insulin Pathway(N) | 45 | 3 | 0.0248 |
| 57 PDGFR-beta signaling pathway(N) | 120 | 5 | 0.0259 |
| 58 EPHA2 forward signaling(N) | 18 | 2 | 0.026 |
| 59 T cell activation(P) | 81 | 4 | 0.0263 |
| 60 IL6-mediated signaling events(N) | 47 | 3 | 0.0277 |
| 61 Integrins in angiogenesis(N) | 47 | 3 | 0.0277 |
| 62 TGF-beta receptor signaling(N) | 47 | 3 | 0.0277 |
| 63 5HT1 type receptor mediated signaling pathway(P) | 19 | 2 | 0.0287 |
| 64 Posttranslational regulation of adherens junction stability and dissassembly(N) | 48 | 3 | 0.0292 |
| 65 Type II diabetes mellitus(K) | 48 | 3 | 0.0292 |
| 66 GPVI-mediated activation cascade(R) | 49 | 3 | 0.0308 |
| 67 Synaptic adhesion-like molecules(R) | 20 | 2 | 0.0315 |
| 68 Mitotic Metaphase and Anaphase(R) | 171 | 6 | 0.0318 |
| 69 Signaling by PDGF(R) | 51 | 3 | 0.034 |
| 70 SHP2 signaling(N) | 51 | 3 | 0.034 |
| 71 E-cadherin signaling in keratinocytes(N) | 21 | 2 | 0.0344 |
| 72 igf-1 signaling pathway(B) | 21 | 2 | 0.0344 |
| 73 PDGFR-alpha signaling pathway(N) | 21 | 2 | 0.0344 |
| 74 Relaxin signaling pathway(K) | 130 | 5 | 0.0347 |
| 75 Mitotic Prometaphase(R) | 175 | 6 | 0.035 |
| 76 inhibition of cellular proliferation by gleevec(B) | 22 | 2 | 0.0374 |
| 77 mapkinase signaling pathway(B) | 53 | 3 | 0.0375 |
| 78 Th1 and Th2 cell differentiation(K) | 92 | 4 | 0.0391 |
| 79 Integration of energy metabolism(R) | 92 | 4 | 0.0391 |
| 80 RAC1 signaling pathway(N) | 54 | 3 | 0.0392 |

TABLE 7.a1-continued

| GeneSet | No_Gene_Set | From_list | P-value |
|---|---|---|---|
| 81 GABA-B_receptor_Il_signaling(P) | 3 | 1 | 0.0405 |
| 82 5HT4 type receptor mediated signaling pathway(P) | 23 | 2 | 0.0405 |
| 83 Signaling events mediated by the Hedgehog family(N) | 23 | 2 | 0.0405 |
| 84 role of erk5 in neuronal survival pathway(B) | 23 | 2 | 0.0405 |
| 85 Interleukin signaling pathway(P) | 55 | 3 | 0.041 |
| 86 Endothelin signaling pathway(P) | 55 | 3 | 0.041 |
| 87 Basal cell carcinoma(K) | 55 | 3 | 0.041 |
| 88 corticosteroids and cardioprotection(B) | 24 | 2 | 0.0438 |
| 89 mtor signaling pathway(B) | 24 | 2 | 0.0438 |
| 90 Myogenesis(R) | 24 | 2 | 0.0438 |
| 91 Signaling by Rho GTPases(R) | 338 | 9 | 0.0451 |
| 92 Chemokine signaling pathway(K) | 187 | 6 | 0.0457 |
| 93 C-MYC pathway(N) | 25 | 2 | 0.0471 |
| 94 fc epsilon receptor i signaling in mast cells(B) | 25 | 2 | 0.0471 |
| 95 tpo signaling pathway(B) | 25 | 2 | 0.0471 |
| 96 Wnt signaling pathway(K) | 143 | 5 | 0.0487 |
| 97 Neurotransmitter receptors and postsynaptic signal transmission(R) | 143 | 5 | 0.0487 |
| 98 Inflammatory mediator regulation of TRP channels(K) | 99 | 4 | 0.0488 |
| 99 Estrogen signaling pathway(K) | 100 | 4 | 0.0503 |
| 100 S1P2 pathway(N) | 26 | 2 | 0.0505 |
| 101 Maturity onset diabetes of the young(K) | 26 | 2 | 0.0505 |
| 102 pdgf signaling pathway(B) | 26 | 2 | 0.0505 |
| 103 Neurotrophic factor-mediated Trk receptor signaling(N) | 60 | 3 | 0.0508 |
| 104 Melanogenesis(K) | 101 | 4 | 0.0518 |
| 105 AGE-RAGE signaling pathway in diabetic complications(K) | 101 | 4 | 0.0518 |

TABLE 7.a2

| | FDR | Nodes | RatioOf-ProteinInGeneSet |
|---|---|---|---|
| 1 | 0.0186 | PIK3R1, KLRC1, KLRC2, KLRC3, KLRD1 | 0.0022 |
| 2 | 0.025 | PIK3R1, IFNGR1, OSMR, CRLF2, IL13RA1, IL4R, LIFR, IL6ST, CSF2RA, PTPN2 | 0.0141 |
| 3 | 0.0259 | PIK3R1, KLRK1, PPP3CC, VAV3, IFNGR1, KLRC1, KLRC2, KLRC3, KLRD1 | 0.0121 |
| 4 | 0.0369 | NEDD4L, PIK3R1, SGK1, SCNN1G, SCNN1B | 0.0035 |
| 5 | 0.0426 | PIK3R1, KLRK1, VAV3, KLRC2, KLRD1 | 0.0039 |
| 6 | 0.0426 | MEF2C, PIK3R1, JUN, RYR3, PPP3CC, ADCY2, PTGS2, PLA2G4A, CACNG2 | 0.0142 |
| 7 | 0.0848 | RIN2, PIK3R1, JUN, CTNNB1, DEPTOR, PTPN2 | 0.0072 |
| 8 | 0.0967 | IFNGR1, OSMR, CRLF2, CCL4L1, IL13RA1, IL4R, LIFR, IL6ST, CCL3L3, CSF2RA, TNFRSF17 | 0.0237 |
| 9 | 0.0967 | ATP6V1G1, SEH1L, PIK3R1, FZD3, FZD9, SGK1, RICTOR, DEPTOR | 0.0138 |
| 10 | 0.0967 | MEF2C, JUN, PTGS2, PLA2G4A | 0.0031 |
| 11 | 0.1613 | MEF2C, JUN, GADD45G, PPP3CC, MECOM, MAP4K3, MAP3K8, CACNA1E, PLA2G4A, CACNG2 | 0.0228 |
| 12 | 0.1613 | GRIN2A, SNAP29 | 0.0005 |
| 13 | 0.1613 | PIK3R1, FZD3, JUN, FZD9, MECOM, ADCY2, PTGS2, ARNT2, CTNNB1, COL4A2, COL4A1, CSF2RA, TRAF5 | 0.0355 |
| 14 | 0.1613 | PIK3R1, FZD3, FZD9, CTNNB1, LIFR, IL6ST, MEIS1 | 0.0127 |
| 15 | 0.1613 | OSMR, LIFR, IL6ST | 0.0021 |
| 16 | 0.1613 | ATP6V1G1, NEDD4L, RYR3, SGK1, SCNN1G, SCNN1B, TRPV4 | 0.013 |
| 17 | 0.1613 | CACNA1E, CACNG2 | 0.0006 |
| 18 | 0.1613 | KLRC1, KLRC2, KLRC3, KLRC4, KLRD1 | 0.0069 |
| 19 | 0.1798 | CYP1B1, ADCY2, PTGS2, PLA2G4A | 0.0045 |
| 20 | 0.1941 | JUN, AKAP5, PTGS2 | 0.0024 |
| 21 | 0.1941 | PIK3R1, PTGS2, COL4A2, COL4A1, TRAF5 | 0.0077 |
| 22 | 0.1941 | JUN, IFNGR1, DYNC1I1, CCL4L1, CCL3L3 | 0.0077 |
| 23 | 0.1941 | PIK3R1, GRIN2A, DAB1 | 0.0025 |
| 24 | 0.1941 | CYFIP2, GRIN2A, JUN, GRIK1, DYNC1I1, CAPN2 | 0.0109 |
| 25 | 0.1953 | PIK3R1, JUN, VAV3 | 0.0026 |
| 26 | 0.1953 | PIK3R1, ADCY2, PTGS2, ADRB2 | 0.005 |
| 27 | 0.2296 | PIK3R1, JUN, CAPN2, ELMO1 | 0.0054 |
| 28 | 0.2296 | CYFIP2, PIK3R1, VAV3, RICTOR, ELMO1 | 0.0084 |
| 29 | 0.2296 | PIK3R1, PPP3CC, PTGS2, PLA2G4A | 0.0055 |
| 30 | 0.2308 | PIK3R1, IL13RA1, IL4R, OPRM1 | 0.0057 |
| 31 | 0.2308 | SGK1, RICTOR, DEPTOR, PDCD4 | 0.0057 |
| 32 | 0.2308 | PIK3R1, JUN, PPP3CC, IFNGR1, PTGS2, CTNNB1, IL6ST | 0.0161 |
| 33 | 0.2308 | PIK3R1, JUN, PPP3CC, IBTK | 0.0058 |
| 34 | 0.2308 | CYFIP2, MEF2C, JUN, RICTOR, CAPN2 | 0.0089 |
| 35 | 0.2308 | MEF2C, MGST1, PIK3R1, JUN, CTNNB1, TRPV4 | 0.0124 |

TABLE 7.a2-continued

| | FDR | Nodes | RatioOf-ProteinInGeneSet |
|---|---|---|---|
| 36 | 0.2308 | GRIN2A, RYR3, PPP3CC, ADCY2, CHRM5, ADRB2, CACNA1E | 0.0163 |
| 37 | 0.2308 | FZD3, JUN, GRB14, PLA2G4A | 0.0059 |
| 38 | 0.2358 | CYFIP2, PIK3R1, CTNNB1 | 0.0032 |
| 39 | 0.2386 | CYP1B1, PTGS2, PLA2G4A | 0.0033 |
| 40 | 0.2427 | PIK3R1, JUN, PPP3CC, VAV3, MAP3K8 | 0.0094 |
| 41 | 0.2427 | PIK3R1, JUN, CCL4L1, MAP3K8, CCL3L3 | 0.0095 |
| 42 | 0.2427 | JUN, MAP3K8 | 0.0013 |
| 43 | 0.2427 | JUN, PPP3CC, IFNGR1, IL4R, IL6ST | 0.0096 |
| 44 | 0.2427 | PIK3R1, IFNGR1, PTPN2 | 0.0036 |
| 45 | 0.2427 | MEF2C, JUN, PLA2G4A | 0.0036 |
| 46 | 0.2427 | PIK3R1, PTGS2, IL13RA1, IL4R, OPRM1 | 0.0098 |
| 47 | 0.2427 | PIK3R1, JUN, PTGS2, MAP3K8, TRAF5 | 0.0098 |
| 48 | 0.2455 | PIK3R1, JUN, PPP3CC, VAV3 | 0.0065 |
| 49 | 0.2565 | PIK3R1, JUN | 0.0014 |
| 50 | 0.2565 | AK4, AK5 | 0.0014 |
| 51 | 0.2565 | GRIN2A, GRIK1, PPP3CC, ADCY2, PLA2G4A | 0.0102 |
| 52 | 0.2573 | PIK3R1, GRIN2A, JUN, VAV3, ADCY2, ADRB2, PDE4B | 0.0179 |
| 53 | 0.2615 | PIK3R1, JUN, VAV3, CTNNB1, CAPN2, COL4A2, COL4A1 | 0.018 |
| 54 | 0.2615 | MEF2C, PIK3R1 | 0.0015 |
| 55 | 0.2615 | JUN, RICTOR, CTNNB1 | 0.004 |
| 56 | 0.2615 | PIK3R1, SGK1, GRB14 | 0.004 |
| 57 | 0.2615 | CYFIP2, JUN, PIN1, PLA2G4A, PTPN2 | 0.0107 |
| 58 | 0.2615 | PIK3R1, VAV3 | 0.0016 |
| 59 | 0.2615 | PIK3R1, JUN, PPP3CC, VAV3 | 0.0072 |
| 60 | 0.2615 | PIK3R1, JUN, IL6ST | 0.0042 |
| 61 | 0.2615 | PIK3R1, VAV3, PI4KA | 0.0042 |
| 62 | 0.2615 | NEDD4L, CTNNB1, PPP1R15A | 0.0042 |
| 63 | 0.2615 | ADCY2, SNAP29 | 0.0017 |
| 64 | 0.2615 | RIN2, ROBO1, CTNNB1 | 0.0043 |
| 65 | 0.2615 | PIK3R1, CACNA1E, SLC2A2 | 0.0043 |
| 66 | 0.2615 | PIK3R1, VAV3, CSF2RA | 0.0044 |
| 67 | 0.2615 | GRIN2A, PTPRD | 0.0018 |
| 68 | 0.2615 | SEH1L, WAPL, CENPA, DYNC1I1, CENPI, CLASP1 | 0.0153 |
| 69 | 0.2615 | PIK3R1, COL4A2, COL4A1 | 0.0046 |
| 70 | 0.2615 | PIK3R1, IFNGR1, IL6ST | 0.0046 |
| 71 | 0.2615 | PIK3R1, CTNNB1 | 0.0019 |
| 72 | 0.2615 | PIK3R1, JUN | 0.0019 |
| 73 | 0.2615 | PIK3R1, JUN | 0.0019 |
| 74 | 0.2615 | PIK3R1, JUN, ADCY2, COL4A2, COL4A1 | 0.0116 |
| 75 | 0.2615 | SEH1L, WAPL, CENPA, DYNC1I1, CENPI, CLASP1 | 0.0156 |
| 76 | 0.2615 | PIK3R1, JUN | 0.002 |
| 77 | 0.2615 | MEF2C, JUN, MAP3K8 | 0.0047 |
| 78 | 0.2615 | JUN, PPP3CC, IFNGR1, IL4R | 0.0082 |
| 79 | 0.2615 | ADCY2, AKAP5, CACNA1E, SLC2A2 | 0.0082 |
| 80 | 0.2615 | CYFIP2, JUN, CTNNB1 | 0.0048 |
| 81 | 0.2615 | ADCY2 | 0.0003 |
| 82 | 0.2615 | ADCY2, SNAP29 | 0.0021 |
| 83 | 0.2615 | PIK3R1, HHAT | 0.0021 |
| 84 | 0.2615 | MEF2C, PIK3R1 | 0.0021 |
| 85 | 0.2615 | IL13RA1, IL4R, IL6ST | 0.0049 |
| 86 | 0.2615 | ADCY2, PTGS2, PLA2G4A | 0.0049 |
| 87 | 0.2615 | FZD3, FZD9, CTNNB1 | 0.0049 |
| 88 | 0.2615 | PIK3R1, ADRB2 | 0.0021 |
| 89 | 0.2615 | PIK3R1, PIN1 | 0.0021 |
| 90 | 0.2615 | MEF2C, CTNNB1 | 0.0021 |
| 91 | 0.2615 | CYFIP2, WIPF3, SEH1L, VAV3, CENPA, DYNC1I1, CENPI, CTNNB1, CLASP1 | 0.0302 |
| 92 | 0.2615 | PIK3R1, VAV3, ADCY2, CCL4L1, ELMO1, CCL3L3 | 0.0167 |
| 93 | 0.2615 | FBXW7, PIN1 | 0.0022 |
| 94 | 0.2615 | PIK3R1, JUN | 0.0022 |
| 95 | 0.2615 | PIK3R1, JUN | 0.0022 |
| 96 | 0.2615 | FZD3, JUN, FZD9, PPP3CC, CTNNB1 | 0.0128 |
| 97 | 0.2615 | GRIN2A, GRIK1, ADCY2, AKAP5, CACNG2 | 0.0128 |
| 98 | 0.2615 | PIK3R1, ADCY2, TRPV4, PLA2G4A | 0.0088 |
| 99 | 0.2615 | PIK3R1, JUN, ADCY2, OPRM1 | 0.0089 |
| 100 | 0.2615 | PIK3R1, JUN | 0.0023 |
| 101 | 0.2615 | NKX2-2, SLC2A2 | 0.0023 |
| 102 | 0.2615 | PIK3R1, JUN | 0.0023 |
| 103 | 0.2615 | NEDD4L, PIK3R1, ELMO1 | 0.0054 |
| 104 | 0.2615 | FZD3, FZD9, ADCY2, CTNNB1 | 0.009 |
| 105 | 0.2615 | PIK3R1, JUN, COL4A2, COL4A1 | 0.009 |

TABLE 7.b1

| GeneSet | No_Gene_Set | From_list |
|---|---|---|
| 106 Breast cancer(K) | 146 | 5 |
| 107 Pyrimidine Metabolism(P) | 4 | 1 |
| 108 Intestinal absorption(R) | 4 | 1 |
| 109 Valine, leucine and isoleucine biosynthesis(K) | 4 | 1 |
| 110 phospholipase c signaling pathway(B) | 4 | 1 |
| 111 Toll receptor signaling pathway(P) | 4 | 1 |
| 112 ifn gamma signaling pathway(B) | 4 | 1 |
| 113 Beta1 adrenergic receptor signaling pathway(P) | 27 | 2 |
| 114 Fc-epsilon receptor I signaling in mast cells(N) | 62 | 3 |
| 115 Endothelins(N) | 62 | 3 |
| 116 Colorectal cancer(K) | 62 | 3 |
| 117 Chagas disease (American trypanosomiasis)(K) | 104 | 4 |
| 118 Signaling events mediated by VEGFR1 and VEGFR2(N) | 63 | 3 |
| 119 LPA receptor mediated events(N) | 63 | 3 |
| 120 Wnt signaling network(N) | 28 | 2 |
| 121 Nucleosome assembly(R) | 29 | 2 |
| 122 Inflammatory bowel disease (IBD)(K) | 65 | 3 |
| 123 Costimulation by the CD28 family(R) | 65 | 3 |
| 124 Cellular senescence(K) | 154 | 5 |
| 125 Surfactant metabolism(R) | 30 | 2 |
| 126 Regulation of CDC42 activity(N) | 30 | 2 |
| 127 Nectin adhesion pathway(N) | 30 | 2 |
| 128 Interleukin-17 signaling(R) | 67 | 3 |
| 129 Renal cell carcinoma(K) | 67 | 3 |
| 130 HTLV-I infection(K) | 258 | 7 |
| 131 Amphetamine addiction(K) | 68 | 3 |
| 132 Regulation of beta-cell development(R) | 31 | 2 |
| 133 trefoil factors initiate mucosal healing(B) | 31 | 2 |
| 134 Huma papillomavirus infection(K) | 313 | 8 |
| 135 Fcgamma receptor (FCGR) dependent phagocytosis(R) | 159 | 5 |
| 136 Netrin-mediated signaling events(N) | 32 | 2 |
| 137 G-protein beta:gamma signalling(R) | 32 | 2 |
| 138 AP-1 transcription factor network(N) | 70 | 3 |
| 139 CDC42 signaling events(N) | 70 | 3 |
| 140 Fc epsilon RI signaling pathway(K) | 70 | 3 |
| 141 Necroptosis(K) | 162 | 5 |
| 142 N-cadherin signaling events(N) | 33 | 2 |
| 143 angiotensin ii mediated activation of jnk pathway via pyk2 dependent signaling(B) | 33 | 2 |
| 144 Transcription regulation by bZIP transcription factor(P) | 6 | 1 |
| 145 General transcription regulation(P) | 6 | 1 |
| 146 d4gdi signaling pathway(B) | 6 | 1 |
| 147 Cellular hexose transport(R) | 6 | 1 |
| 148 Arf6 trafficking events(N) | 34 | 2 |
| 149 IL1-mediated signaling events(N) | 34 | 2 |
| 150 Leishmaniasis(K) | 73 | 3 |
| 151 CGMP-PKG signaling pathway(K) | 168 | 5 |
| 152 Arf6 signaling events(N) | 35 | 2 |
| 153 p73 transcription factor network(N) | 75 | 3 |
| 154 inactivation of gsk3 by akt causes accumulation of b-catenin in alveolar macrophages(B) | 36 | 2 |
| 155 Alzheimer's disease(K) | 171 | 5 |
| 156 Neuroactive ligand-receptor interaction(K) | 278 | 7 |
| 157 Axon guidance mediated by semaphorins(P) | 7 | 1 |
| 158 Reelin signalling pathway(R) | 7 | 1 |
| 159 GMCSF-mediated signaling events(N) | 37 | 2 |
| 160 nfat and hypertrophy of the heart (B) | 37 | 2 |
| 161 Bacterial invasion of epithelial cells(K) | 78 | 3 |
| 162 Regulation of nuclear beta catenin signaling and target gene transcription(N) | 79 | 3 |
| 163 Regulation of RAC1 activity(N) | 38 | 2 |
| 164 Interleukin-3, 5 and GM-CSF signaling(R) | 38 | 2 |
| 165 Axon guidance(K) | 177 | 5 |
| 166 Signaling events regulated by Ret tyrosine kinase(N) | 39 | 2 |
| 167 yaci and bcma stimulation of b cell immune responses(B) | 8 | 1 |
| 168 chaperones modulate interferon signaling pathway(B) | 8 | 1 |
| 169 pertussis toxin-insensitive ccr5 signaling in macrophage(B) | 8 | 1 |
| 170 signal dependent regulation of myogenesis by corepressor mitr(B) | 8 | 1 |
| 171 tsp-1 induced apoptosis in microvascular endothelial cell(B) | 8 | 1 |
| 172 Chemical carcinogenesis(K) | 82 | 3 |
| 173 G alpha (i) signalling events(R) | 345 | 8 |
| 174 Interleukin-2 family signaling(R) | 40 | 2 |
| 175 Intrinsic Pathway for Apoptosis(R) | 41 | 2 |
| 176 Graft-versus-host disease(K) | 41 | 2 |
| 177 Osteoclast differentiation(K) | 132 | 4 |
| 178 ion channels and their functional role in vascular endothelium(B) | 42 | 2 |
| 179 Stabilization and expansion of the E-cadherin adherens junction(N) | 42 | 2 |
| 180 Apelin signaling pathway(K) | 136 | 4 |

TABLE 7.b1-continued

| GeneSet | No_Gene_Set | From_list |
|---|---|---|
| 181 il-2 receptor beta chain in t cell activation(B) | 44 | 2 |
| 182 Post-translational modification: synthesis of GPI-anchored proteins(R) | 89 | 3 |
| 183 Cysteine and methionine metabolism(K) | 45 | 2 |
| 184 Presenilin action in Notch and Wnt signaling(N) | 45 | 2 |
| 185 Basal transcription factors(K) | 45 | 2 |
| 186 Protein digestion and absorption(K) | 90 | 3 |
| 187 Rheumatoid arthritis(K) | 90 | 3 |
| 188 Salivary secretion(K) | 90 | 3 |
| 189 GP1b-IX-V activation signalling(R) | 10 | 1 |
| 190 cxcr4 signaling pathway(B) | 10 | 1 |
| 191 regulators of bone mineralization(B) | 10 | 1 |
| 192 5HT3 type receptor mediated signaling pathway(P) | 10 | 1 |
| 193 Apoptosis(K) | 140 | 4 |
| 194 Morphine addiction(K) | 91 | 3 |
| 195 Calcineurin-regulated NFAT-dependent transcription in lymphocytes(N) | 46 | 2 |
| 196 Carbohydrate digestion and absorption(K) | 46 | 2 |
| 197 TNF receptor signaling pathway(N) | 46 | 2 |
| 198 GnRH signaling pathway(K) | 92 | 3 |
| 199 FGF signaling pathway(N) | 47 | 2 |
| 200 Fc gamma R-mediated phagocytosis(K) | 93 | 3 |
| 201 IL-17 signaling pathway(K) | 93 | 3 |
| 202 il-7 signal transduction(B) | 11 | 1 |
| 203 t cell receptor signaling pathway(B) | 48 | 2 |
| 204 FoxO family signaling(N) | 48 | 2 |
| 205 NF-kappa B signaling pathway(K) | 95 | 3 |
| 206 Heterotrimeric G-protein signaling pathway-Gi alpha and Gs alpha mediated pathway(P) | 147 | 4 |
| 207 Intra-Golgi and retrograde Golgi-to-ER traffic(R) | 147 | 4 |
| 208 Cocaine addiction(K) | 49 | 2 |
| 209 Circadian entrainment(K) | 96 | 3 |
| 210 Viral carcinogenesis(K) | 203 | 5 |

TABLE 7.b2

| | P-value | FDR | Nodes | RatioOfProtein-InGeneSet |
|---|---|---|---|---|
| 106 | 0.0524 | 0.2615 | PIK3R1, FZD3, JUN, FZD9, CTNNB1 | 0.0131 |
| 107 | 0.0536 | 0.2615 | DPYSL5 | 0.0004 |
| 108 | 0.0536 | 0.2615 | SLC2A2 | 0.0004 |
| 109 | 0.0536 | 0.2615 | BCAT2 | 0.0004 |
| 110 | 0.0536 | 0.2615 | PIK3R1 | 0.0004 |
| 111 | 0.0536 | 0.2615 | MAP3K8 | 0.0004 |
| 112 | 0.0536 | 0.2615 | IFNGR1 | 0.0004 |
| 113 | 0.0539 | 0.2615 | ADCY2, SNAP29 | 0.0024 |
| 114 | 0.0549 | 0.2615 | PIK3R1, JUN, PLA2G4A | 0.0055 |
| 115 | 0.0549 | 0.2615 | JUN, ADCY2, PLA2G4A | 0.0055 |
| 116 | 0.0549 | 0.2615 | PIK3R1, JUN, CTNNB1 | 0.0055 |
| 117 | 0.0565 | 0.2615 | PIK3R1, JUN, IFNGR1, CCL3L3 | 0.0093 |
| 118 | 0.0571 | 0.2615 | PIK3R1, CTNNB1, PTPN2 | 0.0056 |
| 119 | 0.0571 | 0.2615 | PIK3R1, JUN, ADCY2 | 0.0056 |
| 120 | 0.0575 | 0.2615 | FZD9, ATP6AP2 | 0.0025 |
| 121 | 0.0611 | 0.2615 | CENPA, CENPI | 0.0026 |
| 122 | 0.0615 | 0.2615 | JUN, IFNGR1, IL4R | 0.0058 |
| 123 | 0.0615 | 0.2615 | PIK3R1, RICTOR, MAP3K8 | 0.0058 |
| 124 | 0.0628 | 0.2615 | PIK3R1, GADD45G, PPP3CC, CAPN2, TRPV4 | 0.0138 |
| 125 | 0.0648 | 0.2615 | CSF2RA, ADGRF5 | 0.0027 |
| 126 | 0.0648 | 0.2615 | VAV3, DOCK11 | 0.0027 |
| 127 | 0.0648 | 0.2615 | PIK3R1, CTNNB1 | 0.0027 |
| 128 | 0.066 | 0.2615 | MEF2C, JUN, MAP3K8 | 0.006 |
| 129 | 0.066 | 0.2615 | PIK3R1, JUN, ARNT2 | 0.006 |
| 130 | 0.0671 | 0.2615 | PIK3R1, FZD3, JUN, FZD9, PPP3CC, ADCY2, CTNNB1 | 0.0231 |
| 131 | 0.0684 | 0.2615 | GRIN2A, JUN, PPP3CC | 0.0061 |
| 132 | 0.0686 | 0.2615 | NKX2-2, SLC2A2 | 0.0028 |
| 133 | 0.0686 | 0.2615 | PIK3R1, CTNNB1 | 0.0028 |
| 134 | 0.0689 | 0.2615 | PIK3R1, FZD3, FZD9, NFX1, PTGS2, CTNNB1, COL4A2, COL4A1 | 0.028 |
| 135 | 0.0699 | 0.2615 | CYFIP2, WIPF3, PIK3R1, VAV3, ELMO1 | 0.0142 |
| 136 | 0.0725 | 0.2615 | PIK3R1, ELMO1 | 0.0029 |
| 137 | 0.0725 | 0.2615 | PIK3R1, CSF2RA | 0.0029 |
| 138 | 0.0732 | 0.2615 | JUN, CTNNB1, BAG1 | 0.0063 |

TABLE 7.b2-continued

| | P-value | FDR | Nodes | RatioOfProtein- InGeneSet |
|---|---|---|---|---|
| 139 | 0.0732 | 0.2615 | PIK3R1, JUN, CTNNB1 | 0.0063 |
| 140 | 0.0732 | 0.2615 | PIK3R1, VAV3, PLA2G4A | 0.0063 |
| 141 | 0.0744 | 0.2615 | IFNGR1, CAPN2, PLA2G4A, TRAF5, CHMP5 | 0.0145 |
| 142 | 0.0764 | 0.2615 | PIK3R1, CTNNB1 | 0.0029 |
| 143 | 0.0764 | 0.2615 | MEF2C, JUN | 0.0029 |
| 144 | 0.0793 | 0.2615 | GTF2E1 | 0.0005 |
| 145 | 0.0793 | 0.2615 | GTF2E1 | 0.0005 |
| 146 | 0.0793 | 0.2615 | JUN | 0.0005 |
| 147 | 0.0793 | 0.2615 | SLC2A2 | 0.0005 |
| 148 | 0.0804 | 0.2615 | CTNNB1, ADRB2 | 0.003 |
| 149 | 0.0804 | 0.2615 | PIK3R1, JUN | 0.003 |
| 150 | 0.0806 | 0.2615 | JUN, IFNGR1, PTGS2 | 0.0065 |
| 151 | 0.0837 | 0.2615 | MEF2C, PIK3R1, PPP3CC, ADCY2, ADRB2 | 0.015 |
| 152 | 0.0845 | 0.2615 | IPCEF1, ADRB2 | 0.0031 |
| 153 | 0.0857 | 0.2615 | NEDD4L, IL4R, PIN1 | 0.0067 |
| 154 | 0.0886 | 0.2615 | PIK3R1, CTNNB1 | 0.0032 |
| 155 | 0.0886 | 0.2615 | GRIN2A, RYR3, PPP3CC, CAPN2, UQCRFS1 | 0.0153 |
| 156 | 0.0908 | 0.2615 | GRIN2A, GRIK1, CHRM5, ADRB2, THRB, GRID1, OPRM1 | 0.0249 |
| 157 | 0.0919 | 0.2615 | DPYSL5 | 0.0006 |
| 158 | 0.0919 | 0.2615 | DAB1 | 0.0006 |
| 159 | 0.0928 | 0.2615 | PIK3R1, CSF2RA | 0.0033 |
| 160 | 0.0928 | 0.2615 | MEF2C, PIK3R1 | 0.0033 |
| 161 | 0.0937 | 0.2615 | PIK3R1, CTNNB1, ELMO1 | 0.007 |
| 162 | 0.0964 | 0.2615 | JUN, CTNNB1, TNIK | 0.0071 |
| 163 | 0.097 | 0.2615 | VAV3, ELMO1 | 0.0034 |
| 164 | 0.097 | 0.2615 | PIK3R1, CSF2RA | 0.0034 |
| 165 | 0.0989 | 0.2615 | DPYSL5, PIK3R1, FZD3, ROBO1, PPP3CC | 0.0158 |
| 166 | 0.1013 | 0.2615 | PIK3R1, JUN | 0.0035 |
| 167 | 0.1043 | 0.2615 | TNFRSF17 | 0.0007 |
| 168 | 0.1043 | 0.2615 | IFNGR1 | 0.0007 |
| 169 | 0.1043 | 0.2615 | JUN | 0.0007 |
| 170 | 0.1043 | 0.2615 | MEF2C | 0.0007 |
| 171 | 0.1043 | 0.2615 | JUN | 0.0007 |
| 172 | 0.1048 | 0.2615 | CYP1B1, MGST1, PTGS2 | 0.0073 |
| 173 | 0.1052 | 0.2615 | PPP3CC, ADCY2, CAMKMT, PDE4B, PLA2G4A, OPRM1, SLC24A1, APLN | 0.0308 |
| 174 | 0.1057 | 0.2615 | PIK3R1, CSF2RA | 0.0036 |
| 175 | 0.1101 | 0.2615 | TP53BP2, PPP3CC | 0.0037 |
| 176 | 0.1101 | 0.2615 | KLRC1, KLRD1 | 0.0037 |
| 177 | 0.1103 | 0.2615 | PIK3R1, JUN, PPP3CC, IFNGR1 | 0.0118 |
| 178 | 0.1145 | 0.2615 | ADRB2, TRPV4 | 0.0038 |
| 179 | 0.1145 | 0.2615 | CYFIP2, CTNNB1 | 0.0038 |
| 180 | 0.1194 | 0.2615 | MEF2C, RYR3, ADCY2, APLN | 0.0122 |
| 181 | 0.1235 | 0.2615 | PIK3R1, PIN1 | 0.0039 |
| 182 | 0.1253 | 0.2615 | CD109, CNTN5, XPNPEP2 | 0.008 |
| 183 | 0.1281 | 0.2615 | MAT1A, BCAT2 | 0.004 |
| 184 | 0.1281 | 0.2615 | JUN, CTNNB1 | 0.004 |
| 185 | 0.1281 | 0.2615 | GTF2E1, TAF2 | 0.004 |
| 186 | 0.1284 | 0.2615 | COL4A2, COL4A1, XPNPEP2 | 0.008 |
| 187 | 0.1284 | 0.2615 | ATP6V1G1, JUN, CCL3L3 | 0.008 |
| 188 | 0.1284 | 0.2615 | RYR3, ADCY2, ADRB2 | 0.008 |
| 189 | 0.1287 | 0.2615 | PIK3R1 | 0.0009 |
| 190 | 0.1287 | 0.2615 | PIK3R1 | 0.0009 |
| 191 | 0.1287 | 0.2615 | COL4A2 | 0.0009 |
| 192 | 0.1287 | 0.2615 | SNAP29 | 0.0009 |
| 193 | 0.1288 | 0.2615 | PIK3R1, JUN, GADD45G, CAPN2 | 0.0125 |
| 194 | 0.1315 | 0.2615 | ADCY2, PDE4B, OPRM1 | 0.0081 |
| 195 | 0.1327 | 0.2615 | JUN, PTGS2 | 0.0041 |
| 196 | 0.1327 | 0.2615 | PIK3R1, SLC2A2 | 0.0041 |
| 197 | 0.1327 | 0.2615 | MAP4K3, TNIK | 0.0041 |
| 198 | 0.1345 | 0.2615 | JUN, ADCY2, PLA2G4A | 0.0082 |
| 199 | 0.1374 | 0.2615 | PIK3R1, JUN | 0.0042 |
| 200 | 0.1377 | 0.2615 | PIK3R1, VAV3, PLA2G4A | 0.0083 |
| 201 | 0.1377 | 0.2615 | JUN, PTGS2, TRAF5 | 0.0083 |
| 202 | 0.1406 | 0.2615 | PIK3R1 | 0.001 |
| 203 | 0.142 | 0.2615 | PIK3R1, JUN | 0.0043 |
| 204 | 0.142 | 0.2615 | SGK1, CTNNB1 | 0.0043 |
| 205 | 0.144 | 0.2615 | PTGS2, CCL4L1, TRAF5 | 0.0085 |
| 206 | 0.146 | 0.2615 | ADCY2, CHRM5, ADRB2, OPRM1 | 0.0131 |
| 207 | 0.146 | 0.2615 | DYNC1I1, SNAP29, PLA2G4A, GALNT2 | 0.0131 |
| 208 | 0.1468 | 0.2615 | GRIN2A, JUN | 0.0044 |
| 209 | 0.1472 | 0.2615 | GRIN2A, RYR3, ADCY2 | 0.0086 |
| 210 | 0.1497 | 0.2615 | PIK3R1, JUN, IL6ST, GTF2E1, TRAF5 | 0.0181 |

TABLE 7.c1

| GeneSet | No_Gene_Set | From_list |
| --- | --- | --- |
| 211 Adrenergic signaling in cardiomyocytes(K) | 149 | 4 |
| 212 Angiopoietin receptor Tie2-mediated signaling(N) | 50 | 2 |
| 213 carm1 and regulation of the estrogen receptor(B) | 12 | 1 |
| 214 insulin signaling pathway(B) | 12 | 1 |
| 215 trka receptor signaling pathway(B) | 12 | 1 |
| 216 repression of pain sensation by the transcriptional regulator dream(B) | 12 | 1 |
| 217 Branched-chain amino acid catabolism | 12 | 1 |
| 218 phospholipase c-epsilon pathway(B) | 12 | 1 |
| 219 Signal regulatory protein family interactions(R) | 12 | 1 |
| 220 erythropoietin mediated neuroprotection through nf-kb(B) | 12 | 1 |
| 221 Aflatoxin activation and detoxification(R) | 12 | 1 |
| 222 Endocrine resistance(K) | 98 | 3 |
| 223 Amoebiasis(K) | 98 | 3 |
| 224 Proteoglycans in cancer(K) | 205 | 5 |
| 225 Signaling by Non-Receptor Tyrosine Kinases(R) | 51 | 2 |
| 226 Amyotrophic lateral sclerosis (ALS)(K) | 51 | 2 |
| 227 Cadherin signaling pathway(P) | 100 | 3 |
| 228 Role of Calcineurin-dependent NFAT signaling in lymphocytes(N) | 52 | 2 |
| 229 Endometrial cancer(K) | 52 | 2 |
| 230 Signaling by MET(R) | 52 | 2 |
| 231 Choline metabolism in cancer(K) | 101 | 3 |
| 232 human cytomegalovirus and map kinase pathways(B) | 13 | 1 |
| 233 Metabolism of Angiotensinogen to Angiotensins(R) | 13 | 1 |
| 234 Sulfur amino acid metabolism(R) | 13 | 1 |
| 235 cadmium induces dna synthesis and proliferation in macrophages(B) | 13 | 1 |
| 236 il12 and stat4 dependent signaling pathway in th1 development(B) | 13 | 1 |
| 237 b cell survival pathway(B) | 13 | 1 |
| 238 multiple antiapoptotic pathways from igf-1r signaling lead to bad phosphorylation(B) | 13 | 1 |
| 239 Hippo signaling pathway(K) | 154 | 4 |
| 240 Iron uptake and transport(R) | 53 | 2 |
| 241 Rap1 signaling pathway(K) | 212 | 5 |
| 242 Glucagon signaling pathway(K) | 103 | 3 |
| 243 IL2-mediated signaling events(N) | 54 | 2 |
| 244 Integrin signalling pathway(P) | 158 | 4 |
| 245 LGI-ADAM interactions(R) | 14 | 1 |
| 246 il 4 signaling pathway(B) | 14 | 1 |
| 247 the 41bb-dependent immune response(B) | 14 | 1 |
| 248 IL5-mediated signaling events(N) | 14 | 1 |
| 249 Mitotic Telophase/Cytokinesis(R) | 14 | 1 |
| 250 oxidative stress induced gene expression via nrf2(B) | 14 | 1 |
| 251 Atypical NF-kappaB pathway(N) | 14 | 1 |
| 252 Ras signaling in the CD4+ TCR pathway(N) | 14 | 1 |
| 253 Interleukin-12 family signaling(R) | 55 | 2 |
| 254 NCAM signaling for neurite out-growth(R) | 56 | 2 |
| 255 calcium signaling by hbx of hepatitis b virus(B) | 15 | 1 |
| 256 Glycosphingolipid biosynthesis - ganglio series(K) | 15 | 1 |
| 257 atm signaling pathway(B) | 15 | 1 |
| 258 Interferon-gamma signaling pathway(P) | 15 | 1 |
| 259 Heterotrimeric G-protein signaling pathway-Gq alpha and Go alpha mediated pathway(P) | 108 | 3 |
| 260 Insulin resistance(K) | 109 | 3 |
| 261 PIP3 activates AKT signaling(R) | 222 | 5 |
| 262 Lysine degradation(K) | 59 | 2 |
| 263 Phase II - Conjugation of compounds(R) | 59 | 2 |
| 264 B cell activation(P) | 59 | 2 |
| 265 Alzheimer disease-presenilin pathway(P) | 111 | 3 |
| 266 Cholinergic synapse(K) | 111 | 3 |
| 267 LPA4-mediated signaling events(N) | 16 | 1 |
| 268 RAF-independent MAPK1/3 activation(R) | 16 | 1 |
| 269 akt signaling pathway(B) | 16 | 1 |
| 270 the igf-1 receptor and longevity(B) | 16 | 1 |
| 271 role of nicotinic acetylcholine receptors in the regulation of apoptosis(B) | 16 | 1 |
| 272 role of pi3k subunit p85 in regulation of actin organization and cell migration(B) | 16 | 1 |
| 273 G alpha (12/13) signalling events(R) | 60 | 2 |
| 274 Coregulation of Androgen receptor activity(N) | 60 | 2 |
| 275 Parkinson disease(P) | 61 | 2 |
| 276 pten dependent cell cycle arrest and apoptosis(B) | 17 | 1 |
| 277 Protein methylation(R) | 17 | 1 |
| 278 hypoxia-inducible factor in the cardivascular system(B) | 17 | 1 |
| 279 Signal amplification(R) | 17 | 1 |
| 280 Arachidonic acid metabolism(K) | 62 | 2 |

TABLE 7.c1-continued

| GeneSet | No_Gene_Set | From_list |
|---|---|---|
| 281 Validated nuclear estrogen receptor alpha network(N) | 62 | 2 |
| 282 Leukocyte transendothelial migration(K) | 116 | 3 |
| 283 map kinase inactivation of smrt corepressor(B) | 18 | 1 |
| 284 Degradation of beta catenin(N) | 18 | 1 |
| 285 Pantothenate and CoA biosynthesis(K) | 18 | 1 |
| 286 2-Oxocarboxylic acid metabolism(K) | 18 | 1 |
| 287 S1P1 pathway(N) | 18 | 1 |
| 288 mets affect on macrophage differentiation(B) | 18 | 1 |
| 289 regulation of pgc-1a(B) | 18 | 1 |
| 290 Longevity regulating pathway - multiple species(K) | 64 | 2 |
| 291 Regulation of retinoblastoma protein(N) | 64 | 2 |
| 292 Purine metabolism(K) | 175 | 4 |
| 293 Thyroid hormone signaling pathway(K) | 118 | 3 |
| 294 Renin secretion(K) | 65 | 2 |
| 295 PI Metabolism(R) | 65 | 2 |
| 296 Receptor-type tyrosine-protein phosphatases(R) | 19 | 1 |
| 297 cystic fibrosis transmembrane conductance regulator (cftr) and beta 2 adrenergic receptor (b2ar) pathway(B) | 19 | 1 |
| 298 tumor suppressor arf inhibits ribosomal biogenesis(B) | 19 | 1 |
| 299 Activation of anterior HOX genes in hindbrain development during early embryogenesis(R) | 66 | 2 |
| 300 HIF-1-alpha transcription factor network(N) | 66 | 2 |
| 301 Circadian Clock(R) | 67 | 2 |
| 302 Central carbon metabolism in cancer(K) | 67 | 2 |
| 303 Long-term potentiation(K) | 67 | 2 |
| 304 TCR signaling in naïve CD4+ T cells(N) | 67 | 2 |
| 305 ISG15 antiviral mechanism(R) | 67 | 2 |
| 306 Platelet activation(K) | 122 | 3 |
| 307 Epithelial cell signaling in Helicobacter pylori infection(K) | 68 | 2 |
| 308 Canonical Wnt signaling pathway(N) | 20 | 1 |
| 309 tnf/stress related signaling(B) | 20 | 1 |
| 310 One carbon pool by folate(K) | 20 | 1 |
| 311 the co-stimulatory signal during t-cell activation(B) | 20 | 1 |
| 312 regulation of bad phosphorylation(B) | 20 | 1 |
| 313 RNA Polymerase Il Transcription(R) | 826 | 14 |
| 314 egf signaling pathway(B) | 21 | 1 |
| 315 Beta2 adrenergic receptor signaling pathway(P) | 21 | 1 |

TABLE 7.c2

| | P-value | FDR | Nodes | RatioOfProtein-InGeneSet |
|---|---|---|---|---|
| 211 | 0.151 | 0.2615 | PIK3R1, ADCY2, ADRB2, CACNG2 | 0.0133 |
| 212 | 0.1515 | 0.2615 | PIK3R1, GRB14 | 0.0045 |
| 213 | 0.1523 | 0.2615 | MEF2C | 0.0011 |
| 214 | 0.1523 | 0.2615 | PIK3R1 | 0.0011 |
| 215 | 0.1523 | 0.2615 | PIK3R1 | 0.0011 |
| 216 | 0.1523 | 0.2615 | JUN | 0.0011 |
| 217 | 0.1523 | 0.2615 | BCAT2 | 0.0011 |
| 218 | 0.1523 | 0.2615 | ADRB2 | 0.0011 |
| 219 | 0.1523 | 0.2615 | FYB1 | 0.0011 |
| 220 | 0.1523 | 0.2615 | JUN | 0.0011 |
| 221 | 0.1523 | 0.2615 | MGST1 | 0.0011 |
| 222 | 0.1537 | 0.2615 | PIK3R1, JUN, ADCY2 | 0.0088 |
| 223 | 0.1537 | 0.2615 | PIK3R1, COL4A2, COL4A1 | 0.0088 |
| 224 | 0.154 | 0.2615 | PIK3R1, FZD3, FZD9, CTNNB1, PDCD4 | 0.0183 |
| 225 | 0.1563 | 0.2615 | ELMO1, KHDRBS2 | 0.0046 |
| 226 | 0.1563 | 0.2615 | GRIN2A, PPP3CC | 0.0046 |
| 227 | 0.1602 | 0.2615 | FZD3, FZD9, CTNNB1 | 0.0089 |
| 228 | 0.1611 | 0.2615 | AKAP5, MAP3K8 | 0.0046 |
| 229 | 0.1611 | 0.2615 | PIK3R1, CTNNB1 | 0.0046 |
| 230 | 0.1611 | 0.2615 | PIK3R1, PTPN2 | 0.0046 |
| 231 | 0.1635 | 0.2615 | PIK3R1, JUN, PLA2G4A | 0.009 |
| 232 | 0.1639 | 0.2615 | PIK3R1 | 0.0012 |
| 233 | 0.1639 | 0.2615 | ATP6AP2 | 0.0012 |
| 234 | 0.1639 | 0.2615 | MAT1A | 0.0012 |
| 235 | 0.1639 | 0.2615 | JUN | 0.0012 |
| 236 | 0.1639 | 0.2615 | JUN | 0.0012 |
| 237 | 0.1639 | 0.2615 | PIK3R1 | 0.0012 |
| 238 | 0.1639 | 0.2615 | PIK3R1 | 0.0012 |
| 239 | 0.164 | 0.2615 | TP53BP2, FZD3, FZD9, CTNNB1 | 0.0138 |
| 240 | 0.1659 | 0.2615 | ATP6V1G1, FBXL5 | 0.0047 |
| 241 | 0.1695 | 0.2615 | PIK3R1, GRIN2A, RAPGEF5, ADCY2, CTNNB1 | 0.019 |
| 242 | 0.1702 | 0.2615 | PPP3CC, ADCY2, SLC2A2 | 0.0092 |

TABLE 7.c2-continued

| | P-value | FDR | Nodes | RatioOfProtein-InGeneSet |
|---|---|---|---|---|
| 243 | 0.1708 | 0.2615 | PIK3R1, JUN | 0.0048 |
| 244 | 0.1746 | 0.2615 | PIK3R1, COL4A2, COL4A1, ELMO1 | 0.0141 |
| 245 | 0.1754 | 0.2615 | CACNG2 | 0.0013 |
| 246 | 0.1754 | 0.2615 | IL4R | 0.0013 |
| 247 | 0.1754 | 0.2615 | JUN | 0.0013 |
| 248 | 0.1754 | 0.2615 | PIK3R1 | 0.0013 |
| 249 | 0.1754 | 0.2615 | WAPL | 0.0013 |
| 250 | 0.1754 | 0.2615 | JUN | 0.0013 |
| 251 | 0.1754 | 0.2615 | PIK3R1 | 0.0013 |
| 252 | 0.1754 | 0.2615 | MAP3K8 | 0.0013 |
| 253 | 0.1757 | 0.2615 | IL6ST, PDCD4 | 0.0049 |
| 254 | 0.1806 | 0.2615 | COL4A2, COL4A1 | 0.005 |
| 255 | 0.1867 | 0.2615 | JUN | 0.0013 |
| 256 | 0.1867 | 0.2615 | ST6GALNAC3 | 0.0013 |
| 257 | 0.1867 | 0.2615 | JUN | 0.0013 |
| 258 | 0.1867 | 0.2615 | IFNGR1 | 0.0013 |
| 259 | 0.1872 | 0.2615 | CHRM5, CACNA1E, OPRM1 | 0.0097 |
| 260 | 0.1907 | 0.2615 | PPP1R3B, PIK3R1, SLC2A2 | 0.0097 |
| 261 | 0.1926 | 0.2615 | PIK3R1, JUN, MECOM, RICTOR, FRK | 0.0198 |
| 262 | 0.1954 | 0.2615 | PRDM2, CAMKMT | 0.0053 |
| 263 | 0.1954 | 0.2615 | MGST1, MAT1A | 0.0053 |
| 264 | 0.1954 | 0.2615 | JUN, VAV3 | 0.0053 |
| 265 | 0.1976 | 0.2615 | FZD3, FZD9, CTNNB1 | 0.0099 |
| 266 | 0.1976 | 0.2615 | PIK3R1, ADCY2, CHRM5 | 0.0099 |
| 267 | 0.1978 | 0.2615 | ADCY2 | 0.0014 |
| 268 | 0.1978 | 0.2615 | IL6ST | 0.0014 |
| 269 | 0.1978 | 0.2615 | PIK3R1 | 0.0014 |
| 270 | 0.1978 | 0.2615 | PIK3R1 | 0.0014 |
| 271 | 0.1978 | 0.2615 | PIK3R1 | 0.0014 |
| 272 | 0.1978 | 0.2615 | PIK3R1 | 0.0014 |
| 273 | 0.2004 | 0.2615 | PIK3R1, VAV3 | 0.0054 |
| 274 | 0.2004 | 0.2615 | VAV3, CTNNB1 | 0.0054 |
| 275 | 0.2054 | 0.2615 | PRKN, FRK | 0.0055 |
| 276 | 0.2088 | 0.2615 | PIK3R1 | 0.0015 |
| 277 | 0.2088 | 0.2615 | CAMKMT | 0.0015 |
| 278 | 0.2088 | 0.2615 | JUN | 0.0015 |
| 279 | 0.2088 | 0.2615 | PLA2G4A | 0.0015 |
| 280 | 0.2104 | 0.2615 | PTGS2, PLA2G4A | 0.0055 |
| 281 | 0.2104 | 0.2615 | JUN, KLRC3 | 0.0055 |
| 282 | 0.2153 | 0.2615 | PIK3R1, VAV3, CTNNB1 | 0.0104 |
| 283 | 0.2196 | 0.2615 | THRB | 0.0016 |
| 284 | 0.2196 | 0.2615 | CTNNB1 | 0.0016 |
| 285 | 0.2196 | 0.2615 | BCAT2 | 0.0016 |
| 286 | 0.2196 | 0.2615 | BCAT2 | 0.0016 |
| 287 | 0.2196 | 0.2615 | PTGS2 | 0.0016 |
| 288 | 0.2196 | 0.2615 | JUN | 0.0016 |
| 289 | 0.2196 | 0.2615 | MEF2C | 0.0016 |
| 290 | 0.2205 | 0.2615 | PIK3R1, ADCY2 | 0.0057 |
| 291 | 0.2205 | 0.2615 | MEF2C, JUN | 0.0057 |
| 292 | 0.2222 | 0.2615 | ADCY2, AK4, AK5, PDE4B | 0.0156 |
| 293 | 0.2224 | 0.2615 | PIK3R1, CTNNB1, THRB | 0.0105 |
| 294 | 0.2255 | 0.2615 | PPP3CC, ADRB2 | 0.0058 |
| 295 | 0.2255 | 0.2615 | PIK3R1, PI4KA | 0.0058 |
| 296 | 0.2303 | 0.2615 | PTPRD | 0.0017 |
| 297 | 0.2303 | 0.2615 | ADRB2 | 0.0017 |
| 298 | 0.2303 | 0.2615 | PIK3R1 | 0.0017 |
| 299 | 0.2305 | 0.2615 | JUN, MEIS1 | 0.0059 |
| 300 | 0.2305 | 0.2615 | JUN, BHLHE41 | 0.0059 |
| 301 | 0.2356 | 0.2615 | MEF2C, BHLHE41 | 0.006 |
| 302 | 0.2356 | 0.2615 | PIK3R1, SLC2A2 | 0.006 |
| 303 | 0.2356 | 0.2615 | GRIN2A, PPP3CC | 0.006 |
| 304 | 0.2356 | 0.2615 | FYB1, MAP3K8 | 0.006 |
| 305 | 0.2356 | 0.2615 | SEH1L, PIN1 | 0.006 |
| 306 | 0.2369 | 0.2615 | PIK3R1, ADCY2, PLA2G4A | 0.0109 |
| 307 | 0.2407 | 0.2615 | ATP6V1G1, JUN | 0.0061 |
| 308 | 0.2409 | 0.2615 | CTNNB1 | 0.0018 |
| 309 | 0.2409 | 0.2615 | JUN | 0.0018 |
| 310 | 0.2409 | 0.2615 | MTHFD1 | 0.0018 |
| 311 | 0.2409 | 0.2615 | PIK3R1 | 0.0018 |
| 312 | 0.2409 | 0.2615 | PIK3R1 | 0.0018 |
| 313 | 0.2478 | 0.2615 | NEDD4L, TP53BP2, JUN, INTS14, SGK1, RICTOR, CTNNB1, FBXW7, LIFR, GTF2E1, PIN1, THRB, E2F6, TAF2 | 0.0738 |
| 314 | 0.2513 | 0.2615 | PIK3R1 | 0.0019 |
| 315 | 0.2513 | 0.2615 | SNAP29 | 0.0019 |

TABLE 7.d1

| GeneSet | No_Gene_Set | From list |
|---|---|---|
| 316 growth hormone signaling pathway(B) | 21 | 1 |
| 317 Beta3 adrenergic receptor signaling pathway(P) | 21 | 1 |
| 318 segmentation clock(B) | 21 | 1 |
| 319 how progesterone initiates the oocyte maturation(B) | 21 | 1 |
| 320 Oxytocin receptor mediated signaling pathway(P) | 21 | 1 |
| 321 Cell Cycle Checkpoints(R) | 246 | 5 |
| 322 Arrhythmogenic right ventricular cardiomyopathy (ARVC)(K) | 72 | 2 |
| 323 Prolactin signaling pathway(K) | 72 | 2 |
| 324 ctcf: first multivalent nuclear factor(B) | 22 | 1 |
| 325 intrinsic prothrombin activation pathway(B) | 22 | 1 |
| 326 ras signaling pathway(B) | 22 | 1 |
| 327 influence of ras and rho proteins on g1 to s transition(B) | 22 | 1 |
| 328 Interleukin-7 signaling(R) | 22 | 1 |
| 329 Nephrin family interactions(R) | 22 | 1 |
| 330 Signaling by TGF-beta Receptor Complex(R) | 73 | 2 |
| 331 Phase I - Functionalization of compounds(R) | 73 | 2 |
| 332 Interferon gamma signaling(R) | 73 | 2 |
| 333 Chronic myeloid leukemia(K) | 73 | 2 |
| 334 RAB GEFs exchange GTP for GDP on RABs(R) | 73 | 2 |
| 335 Metabolism of xenobiotics by cytochrome P450(K) | 74 | 2 |
| 336 Signaling by Insulin receptor(R) | 74 | 2 |
| 337 Metabolism of water-soluble vitamins and cofactors(R) | 74 | 2 |
| 338 alk in cardiac myocytes(B) | 23 | 1 |
| 339 links between pyk2 and map kinases(B) | 23 | 1 |
| 340 G alpha (z) signalling events(R) | 23 | 1 |
| 341 Renin-angiotensin system(K) | 23 | 1 |
| 342 Biosynthesis of unsaturated fatty acids(K) | 23 | 1 |
| 343 regulation of eif-4e and p70s6 kinase(B) | 23 | 1 |
| 344 Visual signal transduction: Rods(N) | 23 | 1 |
| 345 Platinum drug resistance(K) | 75 | 2 |
| 346 Biosynthesis of amino acids(K) | 75 | 2 |
| 347 Oxidative phosphorylation(K) | 133 | 3 |
| 348 Immunoregulatory interactions between a Lymphoid and a non-Lymphoid cell(R) | 194 | 4 |
| 349 FoxO signaling pathway(K) | 134 | 3 |
| 350 Glycerophospholipid biosynthesis(R) | 76 | 2 |
| 351 Hypoxia response via HIF activation(P) | 24 | 1 |
| 352 transcription factor creb and its extracellular signals(B) | 24 | 1 |
| 353 p53 pathway feedback loops 2(P) | 24 | 1 |
| 354 Ephrin B reverse signaling(N) | 24 | 1 |
| 355 skeletal muscle hypertrophy is regulated via akt-mtor pathway(B) | 24 | 1 |
| 356 Alpha9 beta1 integrin signaling events(N) | 24 | 1 |
| 357 Regulation of nuclear SMAD2/3 signaling(N) | 77 | 2 |
| 358 Endocytosis(K) | 260 | 5 |
| 359 Extracellular matrix organization(R) | 261 | 5 |
| 360 Cardiac muscle contraction(K) | 78 | 2 |
| 361 Cellular response to heat stress(R) | 78 | 2 |
| 362 Glucocorticoid receptor regulatory network(N) | 78 | 2 |
| 363 VEGFR3 signaling in lymphatic endothelium(N) | 25 | 1 |
| 364 alpha-Linolenic acid metabolism(K) | 25 | 1 |
| 365 Fatty acid elongation(K) | 25 | 1 |
| 366 Nongenotropic Androgen signaling(N) | 25 | 1 |
| 367 Cortocotropin releasing factor receptor signaling pathway(P) | 25 | 1 |
| 368 Nephrin/Neph1 signaling in the kidney podocyte(N) | 25 | 1 |
| 369 Gene Silencing by RNA(R) | 79 | 2 |
| 370 Signaling by ROBO receptors(R) | 201 | 4 |
| 371 bcr signaling pathway(B) | 26 | 1 |
| 372 5HT2 type receptor mediated signaling pathway(P) | 26 | 1 |
| 373 IL3-mediated signaling events(N) | 26 | 1 |
| 374 bioactive peptide induced signaling pathway(B) | 26 | 1 |
| 375 RXR and RAR heterodimerization with other nuclear receptor(N) | 26 | 1 |
| 376 multi-step regulation of transcription by pitx2(B) | 26 | 1 |
| 377 Vasopressin regulates renal water homeostasis via Aquaporins(R) | 26 | 1 |
| 378 IL27-mediated signaling events(N) | 26 | 1 |
| 379 activation of camp-dependent protein kinase pka(B) | 26 | 1 |
| 380 Vu-arrestins in gpcr desensitization(B) | 26 | 1 |
| 381 Wnt signaling pathway(P) | 267 | 5 |
| 382 Epstein-Barr virus infection(K) | 204 | 4 |
| 383 thrombin signaling and protease-activated receptors(B) | 27 | 1 |
| 384 VEGFR1 specific signals(N) | 27 | 1 |
| 385 p38 MAPK signaling pathway(N) | 27 | 1 |
| 386 Triglyceride metabolism(R) | 27 | 1 |
| 387 Collecting duct acid secretion(K) | 27 | 1 |
| 388 ECM-receptor interaction(K) | 82 | 2 |
| 389 Toll-Like Receptors Cascades(R) | 143 | 3 |
| 390 Chromatin organization(R) | 206 | 4 |
| 391 Taste transduction(K) | 83 | 2 |
| 392 Phospholipase D signaling pathway(K) | 144 | 3 |

TABLE 7.d1-continued

| GeneSet | No_Gene_Set | From list |
|---|---|---|
| 393 role of vu-arrestins in the activation and targeting of map kinases(B) | 28 | 1 |
| 394 Lissencephaly gene (LIS1) in neuronal migration and development(N) | 28 | 1 |
| 395 role of erbb2 in signal transduction and oncology(B) | 28 | 1 |
| 396 Phototransduction(K) | 28 | 1 |
| 397 IL2 signaling events mediated by STAT5(N) | 28 | 1 |
| 398 vegf hypoxia and angiogenesis(B) | 28 | 1 |
| 399 Dorso-ventral axis formation(K) | 28 | 1 |
| 400 Insulin secretion(K) | 85 | 2 |
| 401 Thyroid cancer(K) | 29 | 1 |
| 402 Mitophagy(R) | 29 | 1 |
| 403 Linoleic acid metabolism(K) | 29 | 1 |
| 404 CD40/CD40L signaling(N) | 29 | 1 |
| 405 PI3K-Akt signaling pathway(K) | 341 | 6 |
| 406 tRNA Aminoacylation(R) | 30 | 1 |
| 407 erk and pi-3 kinase are necessary for collagen binding in corneal epithelia(B) | 30 | 1 |
| 408 the information processing pathway at the ifn beta enhancer(B) | 30 | 1 |
| 409 wnt signaling pathway(B) | 30 | 1 |
| 410 IGF1 pathway(N) | 30 | 1 |
| 411 Alpha-synuclein signaling(N) | 30 | 1 |
| 412 Regulation of actin cytoskeleton(K) | 214 | 4 |
| 413 ErbB signaling pathway(K) | 88 | 2 |
| 414 Non-alcoholic fatty liver disease (NAFLD)(K) | 151 | 3 |
| 415 Prostate cancer(K) | 89 | 2 |
| 416 Circadian rhythm(K) | 31 | 1 |
| 417 Aurora A signaling(N) | 31 | 1 |
| 418 IL12 signaling mediated by STAT4(N) | 31 | 1 |
| 419 phospholipids as signalling intermediaries(B) | 31 | 1 |
| 420 Mucin type O-glycan biosynthesis(K) | 31 | 1 |

TABLE 7.d2

| | P-value | FDR | Nodes | RatioOfProtein-InGeneSet |
|---|---|---|---|---|
| 316 | 0.2513 | 0.2615 | PIK3R1 | 0.0019 |
| 317 | 0.2513 | 0.2615 | SNAP29 | 0.0019 |
| 318 | 0.2513 | 0.2615 | CTNNB1 | 0.0019 |
| 319 | 0.2513 | 0.2615 | PIN1 | 0.0019 |
| 320 | 0.2513 | 0.2615 | SNAP29 | 0.0019 |
| 321 | 0.252 | 0.2615 | SEH1L, CENPA, DYNC111, CENPI, CLASP1 | 0.022 |
| 322 | 0.261 | 0.2615 | CTNNB1, CACNG2 | 0.0064 |
| 323 | 0.261 | 0.2615 | PIK3R1, SLC2A2 | 0.0064 |
| 324 | 0.2615 | 0.2615 | PIK3R1 | 0.002 |
| 325 | 0.2615 | 0.2615 | COL4A2 | 0.002 |
| 326 | 0.2615 | 0.2615 | PIK3R1 | 0.002 |
| 327 | 0.2615 | 0.2615 | PIK3R1 | 0.002 |
| 328 | 0.2615 | 0.2615 | CRLF2 | 0.002 |
| 329 | 0.2615 | 0.2615 | PIK3R1 | 0.002 |
| 330 | 0.2661 | 0.2661 | NEDD4L, PPP1R15A | 0.0065 |
| 331 | 0.2661 | 0.2661 | CYP1B1, ARNT2 | 0.0065 |
| 332 | 0.2661 | 0.2661 | IFNGR1, PTPN2 | 0.0065 |
| 333 | 0.2661 | 0.2661 | PIK3R1, MECOM | 0.0065 |
| 334 | 0.2661 | 0.2661 | RIN2, DENND4A | 0.0065 |
| 335 | 0.2711 | 0.2711 | CYP1B1, MGST1 | 0.0066 |
| 336 | 0.2711 | 0.2711 | ATP6V1G1, PIK3R1 | 0.0066 |
| 337 | 0.2711 | 0.2711 | MTHFD1, PTGS2 | 0.0066 |
| 338 | 0.2716 | 0.2716 | MEF2C | 0.0021 |
| 339 | 0.2716 | 0.2716 | JUN | 0.0021 |
| 340 | 0.2716 | 0.2716 | ADCY2 | 0.0021 |
| 341 | 0.2716 | 0.2716 | ATP6AP2 | 0.0021 |
| 342 | 0.2716 | 0.2716 | HACD3 | 0.0021 |
| 343 | 0.2716 | 0.2716 | PIK3R1 | 0.0021 |
| 344 | 0.2716 | 0.2716 | SLC24A1 | 0.0021 |
| 345 | 0.2762 | 0.2762 | MGST1, PIK3R1 | 0.0067 |
| 346 | 0.2762 | 0.2762 | MAT1A, BCAT2 | 0.0067 |
| 347 | 0.2774 | 0.2774 | ATP6V1G1, PPA2, UQCRFS1 | 0.0119 |
| 348 | 0.2788 | 0.2788 | CXADR, KLRK1, KLRC1, KLRD1 | 0.0173 |
| 349 | 0.2811 | 0.2811 | PIK3R1, GADD45G, SGK1 | 0.012 |
| 350 | 0.2813 | 0.2813 | DGAT2, PLA2G4A | 0.0068 |
| 351 | 0.2816 | 0.2816 | PIK3R1 | 0.0021 |
| 352 | 0.2816 | 0.2816 | PIK3R1 | 0.0021 |
| 353 | 0.2816 | 0.2816 | CTNNB1 | 0.0021 |

TABLE 7.d2-continued

| | P-value | FDR | Nodes | RatioOfProtein-InGeneSet |
|---|---|---|---|---|
| 354 | 0.2816 | 0.2816 | PIK3R1 | 0.0021 |
| 355 | 0.2816 | 0.2816 | PIK3R1 | 0.0021 |
| 356 | 0.2816 | 0.2816 | CSF2RA | 0.0021 |
| 357 | 0.2864 | 0.2864 | MEF2C, JUN | 0.0069 |
| 358 | 0.2886 | 0.2886 | WIPF3, NEDD4L, ADRB2, DNAJC6, CHMP5 | 0.0232 |
| 359 | 0.2913 | 0.2913 | CAPN2, ADAM19, COL4A2, COL4A1, TLL1 | 0.0233 |
| 360 | 0.2914 | 0.2914 | UQCRFS1, CACNG2 | 0.007 |
| 361 | 0.2914 | 0.2914 | SEH1L, BAG1 | 0.007 |
| 362 | 0.2914 | 0.2914 | JUN, SGK1 | 0.007 |
| 363 | 0.2914 | 0.2914 | PIK3R1 | 0.0022 |
| 364 | 0.2914 | 0.2914 | PLA2G4A | 0.0022 |
| 365 | 0.2914 | 0.2914 | HACD3 | 0.0022 |
| 366 | 0.2914 | 0.2914 | PIK3R1 | 0.0022 |
| 367 | 0.2914 | 0.2914 | SNAP29 | 0.0022 |
| 368 | 0.2914 | 0.2914 | JUN | 0.0022 |
| 369 | 0.2965 | 0.2965 | SEH1L, PIWIL2 | 0.0071 |
| 370 | 0.3002 | 0.3002 | GSPT1, ROBO1, AKAP5, CLASP1 | 0.018 |
| 371 | 0.3012 | 0.3012 | JUN | 0.0023 |
| 372 | 0.3012 | 0.3012 | SNAP29 | 0.0023 |
| 373 | 0.3012 | 0.3012 | PIK3R1 | 0.0023 |
| 374 | 0.3012 | 0.3012 | PIK3R1 | 0.0023 |
| 375 | 0.3012 | 0.3012 | THRB | 0.0023 |
| 376 | 0.3012 | 0.3012 | CTNNB1 | 0.0023 |
| 377 | 0.3012 | 0.3012 | ADCY2 | 0.0023 |
| 378 | 0.3012 | 0.3012 | IL6ST | 0.0023 |
| 379 | 0.3012 | 0.3012 | ADRB2 | 0.0023 |
| 380 | 0.3012 | 0.3012 | ADRB2 | 0.0023 |
| 381 | 0.3073 | 0.3073 | FZD3, FZD9, PPP3CC, CTNNB1, CDH9 | 0.0239 |
| 382 | 0.3095 | 0.3095 | PIK3R1, JUN, GTF2E1, TRAF5 | 0.0182 |
| 383 | 0.3107 | 0.3107 | PIK3R1 | 0.0024 |
| 384 | 0.3107 | 0.3107 | PIK3R1 | 0.0024 |
| 385 | 0.3107 | 0.3107 | GADD45G | 0.0024 |
| 386 | 0.3107 | 0.3107 | DGAT2 | 0.0024 |
| 387 | 0.3107 | 0.3107 | ATP6V1G1 | 0.0024 |
| 388 | 0.3117 | 0.3117 | COL4A2, COL4A1 | 0.0073 |
| 389 | 0.3147 | 0.3147 | MEF2C, JUN, MAP3K8 | 0.0128 |

TABLE 7.d2-continued

| | P-value | FDR | Nodes | RatioOfProtein-InGeneSet |
|---|---|---|---|---|
| 390 | 0.3157 | 0.3157 | ZZZ3, KDM8, MECOM, PRMT7 | 0.0184 |
| 391 | 0.3167 | 0.3167 | SCNN1G, SCNN1B | 0.0074 |
| 392 | 0.3185 | 0.3185 | PIK3R1, ADCY2, PLA2G4A | 0.0129 |
| 393 | 0.3202 | 0.3202 | ADRB2 | 0.0025 |
| 394 | 0.3202 | 0.3202 | DAB1 | 0.0025 |
| 395 | 0.3202 | 0.3202 | PIK3R1 | 0.0025 |
| 396 | 0.3202 | 0.3202 | SLC24A1 | 0.0025 |
| 397 | 0.3202 | 0.3202 | PIK3R1 | 0.0025 |
| 398 | 0.3202 | 0.3202 | PIK3R1 | 0.0025 |
| 399 | 0.3202 | 0.3202 | PIWIL2 | 0.0025 |
| 400 | 0.3268 | 0.3268 | ADCY2, SLC2A2 | 0.0076 |
| 401 | 0.3295 | 0.3295 | CTNNB1 | 0.0026 |
| 402 | 0.3295 | 0.3295 | PRKN | 0.0026 |
| 403 | 0.3295 | 0.3295 | PLA2G4A | 0.0026 |
| 404 | 0.3295 | 0.3295 | JUN | 0.0026 |
| 405 | 0.3297 | 0.3297 | PIK3R1, OSMR, SGK1, IL4R, COL4A2, COL4A1 | 0.0305 |

TABLE 7.d2-continued

| | P-value | FDR | Nodes | RatioOfProtein-InGeneSet |
|---|---|---|---|---|
| 406 | 0.3387 | 0.3387 | PPA2 | 0.0027 |
| 407 | 0.3387 | 0.3387 | PIK3R1 | 0.0027 |
| 408 | 0.3387 | 0.3387 | JUN | 0.0027 |
| 409 | 0.3387 | 0.3387 | CTNNB1 | 0.0027 |
| 410 | 0.3387 | 0.3387 | PIK3R1 | 0.0027 |
| 411 | 0.3387 | 0.3387 | PRKN | 0.0027 |
| 412 | 0.3405 | 0.3405 | CYFIP2, PIK3R1, VAV3, CHRM5 | 0.0191 |
| 413 | 0.3418 | 0.3418 | PIK3R1, JUN | 0.0079 |
| 414 | 0.3447 | 0.3447 | PIK3R1, JUN, UQCRFS1 | 0.0135 |
| 415 | 0.3468 | 0.3468 | PIK3R1, CTNNB1 | 0.008 |
| 416 | 0.3478 | 0.3478 | BHLHE41 | 0.0028 |
| 417 | 0.3478 | 0.3478 | CENPA | 0.0028 |
| 418 | 0.3478 | 0.3478 | JUN | 0.0028 |
| 419 | 0.3478 | 0.3478 | PIK3R1 | 0.0028 |
| 420 | 0.3478 | 0.3478 | GALNT2 | 0.0028 |

TABLE 7.e1

| GeneSet | No_Gene_Set | From_list |
|---|---|---|
| 421 p38 mapk signaling pathway(B) | 31 | 1 |
| 422 role of egf receptor transactivation by gpcrs in cardiac hypertrophy(B) | 31 | 1 |
| 423 Endosomal Sorting Complex Required For Transport (ESCRT)(R) | 31 | 1 |
| 424 EPHA forward signaling(N) | 31 | 1 |
| 425 Dilated cardiomyopathy(K) | 90 | 2 |
| 426 ROS, RNS production in phagocytes(R) | 32 | 1 |
| 427 roles of vu arrestin dependent recruitment of src kinases in gpcr signaling(B) | 32 | 1 |
| 428 DAG and IP3 signaling(R) | 32 | 1 |
| 429 toll-like receptor pathway(B) | 32 | 1 |
| 430 Trk receptor signaling mediated by the MAPK pathway(N) | 33 | 1 |
| 431 actions of nitric oxide in the heart(B) | 33 | 1 |
| 432 FAS signaling pathway(P) | 33 | 1 |
| 433 EPO signaling pathway(N) | 33 | 1 |
| 434 Longevity regulating pathway(K) | 94 | 2 |
| 435 IL8- and CXCR2-mediated signaling events(N) | 34 | 1 |
| 436 HSP90 chaperone cycle for steroid hormone receptors (SHR)(R) | 34 | 1 |
| 437 SNARE interactions in vesicular transport(K) | 34 | 1 |
| 438 Signalling by NGF(R) | 159 | 3 |
| 439 a6b1 and a6b4 Integrin signaling(N) | 35 | 1 |
| 440 IL2 signaling events mediated by PI3K(N) | 35 | 1 |
| 441 CXCR3-mediated signaling events(N) | 35 | 1 |
| 442 signal transduction through il1r(B) | 35 | 1 |
| 443 Class I PI3K signaling events mediated by Akt(N) | 35 | 1 |
| 444 Signaling events mediated by TCPTP(N) | 35 | 1 |
| 445 Hematopoietic cell lineage(K) | 97 | 2 |
| 446 Ras signaling pathway(K) | 229 | 4 |
| 447 Progesterone-mediated oocyte maturation(K) | 98 | 2 |
| 448 Trk receptor signaling mediated by PI3K and PLC-gamma(N) | 36 | 1 |
| 449 mechanism of gene regulation by peroxisome proliferators via ppara(B) | 36 | 1 |
| 450 chrebp regulation by carbohydrates and camp(B) | 36 | 1 |
| 451 RET signaling(R) | 36 | 1 |
| 452 Phosphatidylinositol signaling system(K) | 99 | 2 |
| 453 Protein processing in endoplasmic reticulum(K) | 165 | 3 |
| 454 Validated transcriptional targets of AP1 family members Fra1 and Fra2(N) | 37 | 1 |
| 455 IL23-mediated signaling events(N) | 37 | 1 |
| 456 rac1 cell motility signaling pathway(B) | 37 | 1 |
| 457 ErbB2/ErbB3 signaling events(N) | 37 | 1 |
| 458 Retrograde endocannabinoid signaling(K) | 101 | 2 |
| 459 TNF signaling(R) | 38 | 1 |
| 460 Signaling events mediated by HDAC Class II(N) | 38 | 1 |
| 461 EPHB forward signaling(N) | 38 | 1 |
| 462 HIF-1 signaling pathway(K) | 103 | 2 |
| 463 Formation of Fibrin Clot (Clotting Cascade)(R) | 39 | 1 |
| 464 Ferroptosis(K) | 40 | 1 |
| 465 Tryptophan metabolism(K) | 40 | 1 |
| 466 Aurora B signaling(N) | 40 | 1 |
| 467 Pre-NOTCH Expression and Processing(R) | 40 | 1 |
| 468 Signaling by FGFR3(R) | 40 | 1 |
| 469 FOXA2 and FOXA3 transcription factor networks(N) | 40 | 1 |
| 470 FOXM1 transcription factor network(N) | 40 | 1 |
| 471 Class I PI3K signaling events(N) | 40 | 1 |
| 472 Nicotine addiction(K) | 40 | 1 |
| 473 Signaling by SCF-KIT(R) | 41 | 1 |

TABLE 7.e1-continued

| GeneSet | No_Gene_Set | From_list |
|---|---|---|
| 474 activation of csk by camp-dependent protein kinase inhibits signaling through the t cell receptor(B) | 41 | 1 |
| 475 Signaling by FGFR4(R) | 41 | 1 |
| 476 BMP receptor signaling(N) | 41 | 1 |
| 477 Fat digestion and absorption(K) | 41 | 1 |
| 478 Signaling by EGFR(R) | 41 | 1 |
| 479 Homologous recombination(K) | 41 | 1 |
| 480 Influenza A(K) | 175 | 3 |
| 481 Cardiac conduction(R) | 107 | 2 |
| 482 Post-translational protein phosphorylation(R) | 107 | 2 |
| 483 FOXA1 transcription factor network(N) | 42 | 1 |
| 484 Plasma membrane estrogen receptor signaling(N) | 42 | 1 |
| 485 Signaling by ERBB2(R) | 43 | 1 |
| 486 PAR1-mediated thrombin signaling events(N) | 43 | 1 |
| 487 Signaling by ERBB4(R) | 43 | 1 |
| 488 Beta3 integrin cell surface interactions(N) | 43 | 1 |
| 489 Cilium Assembly(R) | 179 | 3 |
| 490 Transcriptional misregulation in cancer(K) | 180 | 3 |
| 491 Factors involved in megakaryocyte development and platelet production(R) | 111 | 2 |
| 492 p53 pathway(P) | 44 | 1 |
| 493 Vasopressin-regulated water reabsorption(K) | 44 | 1 |
| 494 Beta-catenin independent WNT signaling(R) | 112 | 2 |
| 495 Serotonergic synapse(K) | 113 | 2 |
| 496 trans-Golgi Network Vesicle Budding(R) | 45 | 1 |
| 497 RhoA signaling pathway(N) | 45 | 1 |
| 498 Ether lipid metabolism(K) | 45 | 1 |
| 499 Validated transcriptional targets of deltaNp63 isoforms(N) | 45 | 1 |
| 500 agrin in postsynaptic differentiation(B) | 45 | 1 |
| 501 Herpes simplex infection(K) | 185 | 3 |
| 502 Regulation of RhoA activity(N) | 46 | 1 |
| 503 Interleukin-10 signaling(R) | 47 | 1 |
| 504 Amyloid fiber formation(R) | 47 | 1 |
| 505 Sphingolipid metabolism(K) | 47 | 1 |
| 506 keratinocyte differentiation(B) | 47 | 1 |
| 507 Apoptotic execution phase(R) | 47 | 1 |
| 508 Toxoplasmosis(K) | 118 | 2 |
| 509 Clathrin-mediated endocytosis(R) | 118 | 2 |
| 510 SUMOylation(R) | 118 | 2 |
| 511 Ceramide signaling pathway(N) | 48 | 1 |
| 512 Fatty acid metabolism(K) | 48 | 1 |
| 513 Valine, leucine and isoleucine degradation(K) | 48 | 1 |
| 514 Class I MHC mediated antigen processing & presentation(R) | 191 | 3 |
| 515 Netrin-1 signaling(R) | 49 | 1 |
| 516 Signaling by FGFR1(R) | 49 | 1 |
| 517 Regulation of Androgen receptor activity(N) | 49 | 1 |
| 518 Malaria(K) | 49 | 1 |
| 519 Intestinal immune network for IgA production(K) | 49 | 1 |
| 520 Regulation of Insulin-like Growth Factor (IGF) transport and uptake by Insulin-like Growth Factor Binding Proteins (IGFBPs)(R) | 120 | 2 |
| 521 Neurotrophin signaling pathway(K) | 121 | 2 |
| 522 Vascular smooth muscle contraction(K) | 121 | 2 |
| 523 Neurexins and neuroligins(R) | 50 | 1 |

TABLE 7.e2

| | P-value | FDR | Nodes | RatioOfPro-teinInGeneSet |
|---|---|---|---|---|
| 421 | 0.3478 | 0.3478 | MEF2C | 0.0028 |
| 422 | 0.3478 | 0.3478 | JUN | 0.0028 |
| 423 | 0.3478 | 0.3478 | CHMP5 | 0.0028 |
| 424 | 0.3478 | 0.3478 | VAV3 | 0.0028 |
| 425 | 0.3517 | 0.3517 | ADCY2, CACNG2 | 0.008 |
| 426 | 0.3567 | 0.3567 | ATP6V1G1 | 0.0029 |
| 427 | 0.3567 | 0.3567 | ADRB2 | 0.0029 |
| 428 | 0.3567 | 0.3567 | ADCY2 | 0.0029 |
| 429 | 0.3567 | 0.3567 | JUN | 0.0029 |
| 430 | 0.3655 | 0.3655 | MEF2C | 0.0029 |
| 431 | 0.3655 | 0.3655 | PIK3R1 | 0.0029 |
| 432 | 0.3655 | 0.3655 | JUN | 0.0029 |
| 433 | 0.3655 | 0.3655 | PIK3R1 | 0.0029 |
| 434 | 0.3715 | 0.3715 | PIK3R1, ADCY2 | 0.0084 |
| 435 | 0.3742 | 0.3742 | ELMO1 | 0.003 |
| 436 | 0.3742 | 0.3742 | DYNC1I1 | 0.003 |

TABLE 7.e2-continued

| | P-value | FDR | Nodes | RatioOfPro-teinInGeneSet |
|---|---|---|---|---|
| 437 | 0.3742 | 0.3742 | SNAP29 | 0.003 |
| 438 | 0.3746 | 0.3746 | MEF2C, PIK3R1, VAV3 | 0.0142 |
| 439 | 0.3828 | 0.3828 | PIK3R1 | 0.0031 |
| 440 | 0.3828 | 0.3828 | PIK3R1 | 0.0031 |
| 441 | 0.3828 | 0.3828 | RICTOR | 0.0031 |
| 442 | 0.3828 | 0.3828 | JUN | 0.0031 |
| 443 | 0.3828 | 0.3828 | RICTOR | 0.0031 |
| 444 | 0.3828 | 0.3828 | PTPN2 | 0.0031 |
| 445 | 0.3861 | 0.3861 | IL4R, CSF2RA | 0.0087 |
| 446 | 0.3872 | 0.3872 | PIK3R1, GRIN2A, RAPGEF5, PLA2G4A | 0.0205 |
| 447 | 0.391 | 0.391 | PIK3R1, ADCY2 | 0.0088 |
| 448 | 0.3913 | 0.3913 | PIK3R1 | 0.0032 |
| 449 | 0.3913 | 0.3913 | JUN | 0.0032 |
| 450 | 0.3913 | 0.3913 | ADRB2 | 0.0032 |
| 451 | 0.3913 | 0.3913 | PIK3R1 | 0.0032 |

609

TABLE 7.e2-continued

| | P-value | FDR | Nodes | RatioOfProteinInGeneSet |
|---|---|---|---|---|
| 452 | 0.3958 | 0.3958 | PIK3R1, PI4KA | 0.0088 |
| 453 | 0.3969 | 0.3969 | CAPN2, BAG1, PPP1R15A | 0.0147 |
| 454 | 0.3996 | 0.3996 | JUN | 0.0033 |
| 455 | 0.3996 | 0.3996 | PIK3R1 | 0.0033 |
| 456 | 0.3996 | 0.3996 | PIK3R1 | 0.0033 |
| 457 | 0.3996 | 0.3996 | JUN | 0.0033 |
| 458 | 0.4054 | 0.4054 | ADCY2, PTGS2 | 0.009 |
| 459 | 0.4079 | 0.4079 | SMPD3 | 0.0034 |
| 460 | 0.4079 | 0.4079 | MEF2C | 0.0034 |
| 461 | 0.4079 | 0.4079 | PIK3R1 | 0.0034 |
| 462 | 0.415 | 0.415 | PIK3R1, IFNGR1 | 0.0092 |
| 463 | 0.416 | 0.416 | SERPIND1 | 0.0035 |
| 464 | 0.424 | 0.424 | SLC39A14 | 0.0036 |
| 465 | 0.424 | 0.424 | CYP1B1 | 0.0036 |
| 466 | 0.424 | 0.424 | CENPA | 0.0036 |
| 467 | 0.424 | 0.424 | JUN | 0.0036 |
| 468 | 0.424 | 0.424 | PIK3R1 | 0.0036 |
| 469 | 0.424 | 0.424 | SLC2A2 | 0.0036 |
| 470 | 0.424 | 0.424 | CENPA | 0.0036 |
| 471 | 0.424 | 0.424 | SGK1 | 0.0036 |
| 472 | 0.424 | 0.424 | GRIN2A | 0.0036 |
| 473 | 0.4319 | 0.4319 | PIK3R1 | 0.0037 |
| 474 | 0.4319 | 0.4319 | ADRB2 | 0.0037 |
| 475 | 0.4319 | 0.4319 | PIK3R1 | 0.0037 |
| 476 | 0.4319 | 0.4319 | PPP1R15A | 0.0037 |
| 477 | 0.4319 | 0.4319 | DGAT2 | 0.0037 |
| 478 | 0.4319 | 0.4319 | PIK3R1 | 0.0037 |
| 479 | 0.4319 | 0.4319 | RAD51B | 0.0037 |
| 480 | 0.4335 | 0.4335 | PIK3R1, JUN, IFNGR1 | 0.0156 |
| 481 | 0.4339 | 0.4339 | RYR3, CACNG2 | 0.0096 |
| 482 | 0.4339 | 0.4339 | SERPIND1, NUCB1 | 0.0096 |
| 483 | 0.4397 | 0.4397 | JUN | 0.0038 |
| 484 | 0.4397 | 0.4397 | PIK3R1 | 0.0038 |
| 485 | 0.4474 | 0.4474 | PIK3R1 | 0.0038 |
| 486 | 0.4474 | 0.4474 | PIK3R1 | 0.0038 |
| 487 | 0.4474 | 0.4474 | PIK3R1 | 0.0038 |
| 488 | 0.4474 | 0.4474 | COL4A1 | 0.0038 |

610

TABLE 7.e2-continued

| | P-value | FDR | Nodes | RatioOfProteinInGeneSet |
|---|---|---|---|---|
| 489 | 0.4479 | 0.4479 | CC2D2A, IFT27, CLASP1 | 0.016 |
| 490 | 0.4515 | 0.4515 | MEF2C, ARNT2, MEIS1 | 0.0161 |
| 491 | 0.4524 | 0.4524 | RAD51B, DOCK11 | 0.0099 |
| 492 | 0.455 | 0.455 | GADD45G | 0.0039 |
| 493 | 0.455 | 0.455 | DYNC1I1 | 0.0039 |
| 494 | 0.457 | 0.457 | FZD3, CTNNB1 | 0.01 |
| 495 | 0.4615 | 0.4615 | PTGS2, PLA2G4A | 0.0101 |
| 496 | 0.4624 | 0.4624 | DNAJC6 | 0.004 |
| 497 | 0.4624 | 0.4624 | JUN | 0.004 |
| 498 | 0.4624 | 0.4624 | PLA2G4A | 0.004 |
| 499 | 0.4624 | 0.4624 | FBXW7 | 0.004 |
| 500 | 0.4624 | 0.4624 | JUN | 0.004 |
| 501 | 0.4693 | 0.4693 | JUN, IFNGR1, TRAF5 | 0.0165 |
| 502 | 0.4698 | 0.4698 | VAV3 | 0.0041 |
| 503 | 0.4771 | 0.4771 | PTGS2 | 0.0042 |
| 504 | 0.4771 | 0.4771 | PRKN | 0.0042 |
| 505 | 0.4771 | 0.4771 | SMPD3 | 0.0042 |
| 506 | 0.4771 | 0.4771 | JUN | 0.0042 |
| 507 | 0.4771 | 0.4771 | CTNNB1 | 0.0042 |
| 508 | 0.484 | 0.484 | PIK3R1, IFNGR1 | 0.0105 |
| 509 | 0.484 | 0.484 | ADRB2, DNAJC6 | 0.0105 |
| 510 | 0.484 | 0.484 | NSMCE1, SEH1L | 0.0105 |
| 511 | 0.4843 | 0.4843 | SMPD3 | 0.0043 |
| 512 | 0.4843 | 0.4843 | HACD3 | 0.0043 |
| 513 | 0.4843 | 0.4843 | BCAT2 | 0.0043 |
| 514 | 0.4903 | 0.4903 | NEDD4L, FBXL5, FBXW7 | 0.0171 |
| 515 | 0.4914 | 0.4914 | ROBO1 | 0.0044 |
| 516 | 0.4914 | 0.4914 | PIK3R1 | 0.0044 |
| 517 | 0.4914 | 0.4914 | JUN | 0.0044 |
| 518 | 0.4914 | 0.4914 | KLRK1 | 0.0044 |
| 519 | 0.4914 | 0.4914 | TNFRSF17 | 0.0044 |
| 520 | 0.4928 | 0.4928 | SERPIND1, NUCB1 | 0.0107 |
| 521 | 0.4972 | 0.4972 | PIK3R1, JUN | 0.0108 |
| 522 | 0.4972 | 0.4972 | ADCY2, PLA2G4A | 0.0108 |
| 523 | 0.4983 | 0.4983 | GRIN2A | 0.0045 |

TABLE 8.1a

| No. | Group | Probe | GeneLocus | Probe_Count_Total |
|---|---|---|---|---|
| 1 | A | ORF130_1_181484002_181486199_181499646_181512034_RF | N/A | N/A |
| 2 | A | ORF121_5_68461134_68466125_68476885_68484945_RR | N/A | N/A |
| 3 | A | ORF197_13_110131405_110134324_110146402_110150942_FR | N/A | N/A |
| 4 | A | ORF138_15_65573794_65596385_65611369_65614380_RF | N/A | N/A |
| 5 | A | ORF11_10_76403646_76410014_76489182_76492128_RR | N/A | N/A |
| 6 | A | ORF14_10_80184350_80188816_80268946_80271961_RF | N/A | N/A |
| 7 | A | ORF133_1_103373638_103377704_103450404_103453588_RF | N/A | N/A |
| 8 | A | ORF16_6_154154477_154163186_154217494_154220454_RR | N/A | N/A |
| 9 | A | ORF138_2_87446096_87451261_87563076_87564920_RF | N/A | N/A |
| 10 | A | ORF198_9_28270698_28275294_28314155_28333777_RF | N/A | N/A |
| 11 | A | ORF151_12_30089465_30094558_30144610_30146709_RR | N/A | N/A |
| 12 | A | ORF175_19_29325557_29328725_29376361_29378170_RR | N/A | N/A |
| 13 | B | ORF198_6_47004707_47009616_47060758_47069708_RF | N/A | N/A |
| 14 | B | ORF161_15_76059101_76063008_76127902_76129439_FR | N/A | N/A |
| 15 | B | ORF18_9_94753448_94757906_94818790_94822742_FF | N/A | N/A |
| 16 | B | ORF19_4_37859966_37862832_37889307_37892348_FR | N/A | N/A |
| 17 | B | ORF115_8_41556026_41557719_41620524_41625614_RR | N/A | N/A |
| 18 | B | ORF18_5_53020744_53026231_53104495_53107169_FR | N/A | N/A |
| 19 | B | ORF13_3_10213510_10218995_10289864_10293604_RF | N/A | N/A |
| 20 | B | ORF16_2_104860979_104864045_104945453_104950314_RR | N/A | N/A |
| 21 | B | ORF19_11_49172113_49176734_49212875_49219818_RF | N/A | N/A |
| 22 | B | ORF138_5_14296086_14298950_14351872_14353515_RF | N/A | N/A |
| 23 | B | ORF191_5_14296086_14298950_14364873_14369388_RR | N/A | N/A |
| 24 | B | ORF11_4_151874649_151880301_151939544_151951330_FF | N/A | N/A |
| 25 | B | ORF170_2_42093750_42101196_42135668_42138124_RR | N/A | N/A |
| 26 | B | ORF186_1_98703842_98709502_98720841_98724148_RF | N/A | N/A |
| 27 | B | ORF197_9_28314155_28333777_28371887_28374860_FF | N/A | N/A |
| 28 | B | ORF121_2_169230822_169232519_169312990_169323273_RF | N/A | N/A |
| 29 | B | ORF196_18_61281289_61284639_61298113_61310562_RR | N/A | N/A |
| 30 | B | ORF187_2_68359452_68365969_68410496_68416848_FF | N/A | N/A |
| 31 | B | ORF147_1_229796281_229797522_229849427_229855718_RF | N/A | N/A |
| 32 | B | ORF180_5_14296086_14298950_14331605_14334109_RR | N/A | N/A |
| 33 | B | ORF18_4_151874649_151880301_152011202_152016397_FR | N/A | N/A |

TABLE 8.1a-continued

| No. | Group | Probe | GeneLocus | Probe_Count_Total |
|---|---|---|---|---|
| 34 | B | ORF196_8_101906298_101909241_101944457_101954546_FF | N/A | N/A |
| 35 | B | ORF158_2_71849462_71852445_71889643_71894860_FF | N/A | N/A |
| 36 | B | ORF1_2_122384211_122392026_122423621_122431761_FR | N/A | N/A |
| 37 | B | ORF18_14_99815362_99818414_99884900_99886697_FF | N/A | N/A |
| 38 | B | ORF143_5_14296086_14298950_14319858_14323303_RR | N/A | N/A |
| 39 | B | ORF168_13_50679892_50686027_50716471_50721185_RR | N/A | N/A |
| 40 | B | ORF14_3_84107388_84117146_84158429_84159782_FF | N/A | N/A |
| 41 | B | ORF103_1_152785124_152809368_152824653_152831895_FR | N/A | N/A |
| 42 | B | ORF176_5_14296086_14298950_14334109_14335762_RR | N/A | N/A |
| 43 | B | ORF14_10_23011505_23013473_23046337_23050583_FR | N/A | N/A |
| 44 | B | ORF106_2_122420370_122422532_122487405_122491476_FF | N/A | N/A |
| 45 | B | ORF199_1_98683897_98688922_98703842_98709502_FF | N/A | N/A |
| 46 | B | ORF184_1_116953472_116956520_117001584_117004481_FR | N/A | N/A |
| 47 | B | ORF147_2_104614222_104616408_104659695_104660711_RR | N/A | N/A |
| 48 | B | ORF14_6_152926115_152930237_153001408_153002544_RR | N/A | N/A |
| 49 | B | ORF158_2_38148629_38155476_38173151_38175882_FF | N/A | N/A |
| 50 | B | ORF123_10_104238473_104242119_104302206_104311403_FF | N/A | N/A |
| 51 | B | ORF16_11_86195747_86200973_86253845_86255008_RF | N/A | N/A |

TABLE 8.1b

| No. | Group | Probe_Count_Sig | HyperG_Stats | FDR_HyperG | Percent_Sig | logFC | AveExpr |
|---|---|---|---|---|---|---|---|
| 1 | A | N/A | N/A | N/A | N/A | −0.902920687 | −0.902920687 |
| 2 | A | N/A | N/A | N/A | N/A | −0.889155137 | 0.889155137 |
| 3 | A | N/A | N/A | N/A | N/A | −0.86271955 | −0.86271955 |
| 4 | A | N/A | N/A | N/A | N/A | −0.848473602 | −0.848473602 |
| 5 | A | N/A | N/A | N/A | N/A | −0.835298815 | −0.835298815 |
| 6 | A | N/A | N/A | N/A | N/A | −0.782417152 | −0.782417152 |
| 7 | A | N/A | N/A | N/A | N/A | −0.778372431 | −0.778372431 |
| 8 | A | N/A | N/A | N/A | N/A | −0.745666862 | −0.745666862 |
| 9 | A | N/A | N/A | N/A | N/A | −0.735464874 | −0.735464874 |
| 10 | A | N/A | N/A | N/A | N/A | −0.727431725 | 0.727431725 |
| 11 | A | N/A | N/A | N/A | N/A | −0.716810383 | −0.716810383 |
| 12 | A | N/A | N/A | N/A | N/A | −0.715276704 | −0.715276704 |
| 13 | B | N/A | N/A | N/A | N/A | −0.687883693 | −0.687883693 |
| 14 | B | N/A | N/A | N/A | N/A | −0.681233027 | −0.681233027 |
| 15 | B | N/A | N/A | N/A | N/A | −0.678970006 | −0.678970006 |
| 16 | B | N/A | N/A | N/A | N/A | −0.678791947 | −0.678791947 |
| 17 | B | N/A | N/A | N/A | N/A | −0.665154204 | −0.665154204 |
| 18 | B | N/A | N/A | N/A | N/A | −0.663925239 | −0.663925239 |
| 19 | B | N/A | N/A | N/A | N/A | −0.656008231 | −0.656008231 |
| 20 | B | N/A | N/A | N/A | N/A | −0.648923367 | −0.648923367 |
| 21 | B | N/A | N/A | N/A | N/A | 0.648598444 | −0.648598444 |
| 22 | B | N/A | N/A | N/A | N/A | −0.643334074 | −0.643334074 |
| 23 | B | N/A | N/A | N/A | N/A | −0.639512041 | −0.639512041 |
| 24 | B | N/A | N/A | N/A | N/A | −0.637859012 | −0.637859012 |
| 25 | B | N/A | N/A | N/A | N/A | −0.632921191 | −0.632921191 |
| 26 | B | N/A | N/A | N/A | N/A | −0.62980323 | −0.62980323 |
| 27 | B | N/A | N/A | N/A | N/A | −0.627429902 | −0.627429902 |
| 28 | B | N/A | N/A | N/A | N/A | −0.626569707 | −0.626569707 |
| 29 | B | N/A | N/A | N/A | N/A | −0.624898453 | −0.624898453 |
| 30 | B | N/A | N/A | N/A | N/A | −0.624119123 | 0.624119123 |
| 31 | B | N/A | N/A | N/A | N/A | −0.621507065 | −0.621507065 |
| 32 | B | N/A | N/A | N/A | N/A | −0.621446146 | −0.621446146 |
| 33 | B | N/A | N/A | N/A | N/A | −0.618124191 | −0.618124191 |
| 34 | B | N/A | N/A | N/A | N/A | −0.617660574 | −0.617660574 |
| 35 | B | N/A | N/A | N/A | N/A | −0.617154289 | −0.617154289 |
| 36 | B | N/A | N/A | N/A | N/A | −0.613623079 | −0.613623079 |
| 37 | B | N/A | N/A | N/A | N/A | −0.612984927 | −0.612984927 |
| 38 | B | N/A | N/A | N/A | N/A | −0.612332048 | −0.612332048 |
| 39 | B | N/A | N/A | N/A | N/A | 0.6089308 | −0.6089308 |
| 40 | B | N/A | N/A | N/A | N/A | −0.605636682 | −0.605636682 |
| 41 | B | N/A | N/A | N/A | N/A | −0.604074502 | −0.604074502 |
| 42 | B | N/A | N/A | N/A | N/A | −0.603384069 | −0.603384069 |
| 43 | B | N/A | N/A | N/A | N/A | −0.603375187 | −0.603375187 |
| 44 | B | N/A | N/A | N/A | N/A | −0.601854078 | −0.601854078 |
| 45 | B | N/A | N/A | N/A | N/A | −0.597131608 | −0.597131608 |
| 46 | B | N/A | N/A | N/A | N/A | −0.595769876 | −0.595769876 |
| 47 | B | N/A | N/A | N/A | N/A | −0.593494634 | −0.593494634 |
| 48 | B | N/A | N/A | N/A | N/A | −0.590844113 | −0.590844113 |
| 49 | B | N/A | N/A | N/A | N/A | −0.589565118 | −0.589565118 |
| 50 | B | N/A | N/A | N/A | N/A | −0.587157203 | −0.587157203 |
| 51 | B | N/A | N/A | N/A | N/A | −0.587033847 | −0.587033847 |

TABLE 8.1c

| No. | Group | t | P.Value | adj.P.Val | B | FC |
|---|---|---|---|---|---|---|
| 1 | A | −9.38731335 | 0.000000715 | 0.0000326 | 6.348570481 | 0.534802944 |
| 2 | A | −4.961829562 | 0.000331268 | 0.001966927 | 0.021524681 | 0.539930217 |
| 3 | A | −6.034736926 | 0.0000593 | 0.000574116 | 1.796815874 | 0.549914964 |
| 4 | A | −13.20468402 | 0.0000000168 | 0.00000376 | 10.11545576 | 0.555372019 |
| 5 | A | −6.8024921 | 0.0000191 | 0.000267386 | 2.96804814 | 0.560466942 |
| 6 | A | −6.609249636 | 0.0000252 | 0.000320879 | 2.681009587 | 0.581391888 |
| 7 | A | −6.081742554 | 0.0000552 | 0.000545563 | 1.870907921 | 0.583024158 |
| 8 | A | −5.056523908 | 0.000282775 | 0.001751743 | 0.184531457 | 0.596392135 |
| 9 | A | −5.640110527 | 0.000109603 | 0.000882937 | 1.162457071 | 0.600624457 |
| 10 | A | −6.076430002 | 0.0000557 | 0.000548855 | 1.862549761 | 0.603978155 |
| 11 | A | −4.824893047 | 0.000417375 | 0.002330466 | −0.216233165 | 0.608441143 |
| 12 | A | −3.308889367 | 0.006249188 | 0.01792273 | −2.96908133 | 0.609088299 |
| 13 | B | −5.047203264 | 0.000287199 | 0.001773127 | 0.168538832 | 0.620763789 |
| 14 | B | −5.981769231 | 0.0000643 | 0.000608428 | 1.712951136 | 0.623632048 |
| 15 | B | −5.298211018 | 0.000189869 | 0.001308735 | 0.595183735 | 0.624611049 |
| 16 | B | −5.775445295 | 0.0000886 | 0.000759746 | 1.382486511 | 0.624688144 |
| 17 | B | −6.870629659 | 0.0000173 | 0.000250977 | 3.068032199 | 0.630621296 |
| 18 | B | −5.17542456 | 0.000232218 | 0.001516237 | 0.387535885 | 0.631158722 |
| 19 | B | −19.24384862 | 0.000000000224 | 0.000000504 | 14.21218591 | 0.634631822 |
| 20 | B | −6.714680693 | 0.0000217 | 0.000290585 | 2.838254337 | 0.637756071 |
| 21 | B | −3.385076424 | 0.005428065 | 0.016033727 | −2.827972579 | 0.637899723 |
| 22 | B | −11.46063564 | 0.0000000818 | 0.00000877 | 8.54339294 | 0.64023166 |
| 23 | B | −11.34612693 | 0.0000000914 | 0.00000932 | 8.432106811 | 0.64193003 |
| 24 | B | −7.067484022 | 0.0000132 | 0.00020839 | 3.353340227 | 0.64266597 |
| 25 | B | −5.40483293 | 0.000159687 | 0.001154243 | 0.77382722 | 0.644869351 |
| 26 | B | −6.599617102 | 0.0000256 | 0.000324001 | 2.666566302 | 0.646264554 |
| 27 | B | −6.233575612 | 0.0000439 | 0.000464641 | 2.108096562 | 0.647328576 |
| 28 | B | −5.605724746 | 0.000115744 | 0.000917397 | 1.106141508 | 0.647714656 |
| 29 | B | −9.05963493 | 0.00000104 | 0.0000411 | 5.963390203 | 0.648465419 |
| 30 | B | −3.323834796 | 0.006078736 | 0.017528448 | −2.94140664 | 0.648815809 |
| 31 | B | −8.313648073 | 0.00000256 | 0.0000720 | 5.042225938 | 0.64999158 |
| 32 | B | −12.9536673 | 0.0000000209 | 0.00000421 | 9.902524499 | 0.650019027 |
| 33 | B | −4.502206964 | 0.000726605 | 0.00351567 | −0.785529316 | 0.651517488 |
| 34 | B | −9.529608459 | 0.000000609 | 0.0000293 | 6.512318007 | 0.65172689 |
| 35 | B | −11.11023611 | 0.000000115 | 0.0000106 | 8.199449941 | 0.651955641 |
| 36 | B | −9.755373492 | 0.000000474 | 0.0000251 | 6.76787139 | 0.653553353 |
| 37 | B | −4.777223426 | 0.000452603 | 0.002475169 | −0.299551671 | 0.653842506 |
| 38 | B | −9.483635178 | 0.000000641 | 0.0000302 | 6.45964271 | 0.654138463 |
| 39 | B | −8.685447734 | 0.00000162 | 0.0000543 | 5.509240867 | 0.655682456 |
| 40 | B | −6.703813142 | 0.0000220 | 0.000293554 | 2.822117105 | 0.657181292 |
| 41 | B | −6.976761828 | 0.0000149 | 0.000226924 | 3.222506325 | 0.657893288 |
| 42 | B | −11.37023574 | 0.0000000893 | 0.00000920 | 8.45562596 | 0.658208212 |
| 43 | B | −9.529496253 | 0.000000609 | 0.0000293 | 6.512189708 | 0.658212264 |
| 44 | B | −12.35548287 | 0.0000000355 | 0.00000557 | 9.377666266 | 0.658906618 |
| 45 | B | −5.239946908 | 0.000208849 | 0.00140058 | 0.496906124 | 0.661066995 |
| 46 | B | −4.261340534 | 0.001108625 | 0.004818807 | −1.218000824 | 0.661691258 |
| 47 | B | −10.20742817 | 0.000000291 | 0.0000186 | 7.264427169 | 0.66273562 |
| 48 | B | −7.421354391 | 0.00000811 | 0.000151023 | 3.853159105 | 0.663954317 |
| 49 | B | −4.819712462 | 0.00042106 | 0.002345452 | −0.225274349 | 0.664543195 |
| 50 | B | −5.492987202 | 0.000138558 | 0.001043057 | 0.920343575 | 0.66565327 |
| 51 | B | −6.344949678 | 0.0000372 | 0.000414647 | 2.280011436 | 0.665710188 |

TABLE 8.1d

| No. | Group | FC_1 | LS | Loop Detected |
|---|---|---|---|---|
| 1 | A | −1.869847597 | −1 | Severe Autism |
| 2 | A | −1.852091195 | −1 | Severe Autism |
| 3 | A | −1.818462972 | −1 | Severe Autism |
| 4 | A | −1.800594855 | −1 | Severe Autism |
| 5 | A | −1.784226554 | −1 | Severe Autism |
| 6 | A | −1.720010238 | −1 | Severe Autism |
| 7 | A | −1.715194793 | −1 | Severe Autism |
| 8 | A | −1.67674914 | −1 | Severe Autism |
| 9 | A | −1.664933868 | −1 | Severe Autism |
| 10 | A | −1.655689021 | −1 | Severe Autism |
| 11 | A | −1.643544345 | −1 | Severe Autism |
| 12 | A | −1.641798079 | −1 | Severe Autism |
| 13 | B | −1.610918708 | −1 | Severe Autism |
| 14 | B | −1.603509639 | −1 | Severe Autism |
| 15 | B | −1.600996335 | −1 | Severe Autism |
| 16 | B | −1.600798751 | −1 | Severe Autism |
| 17 | B | −1.585737757 | −1 | Severe Autism |
| 18 | B | −1.584387517 | −1 | Severe Autism |
| 19 | B | −1.575716762 | −1 | Severe Autism |

TABLE 8.1d-continued

| No. | Group | FC_1 | LS | Loop Detected |
|---|---|---|---|---|
| 20 | B | −1.567997618 | −1 | Severe Autism |
| 21 | B | −1.567644513 | −1 | Severe Autism |
| 22 | B | −1.561934620 | −1 | Severe Autism |
| 23 | B | −1.557802179 | −1 | Severe Autism |
| 24 | B | −1.556018283 | −1 | Severe Autism |
| 25 | B | −1.550701701 | −1 | Severe Autism |
| 26 | B | −1.547353934 | −1 | Severe Autism |
| 27 | B | −1.544810528 | −1 | Severe Autism |
| 28 | B | −1.543889722 | −1 | Severe Autism |
| 29 | B | −1.542102277 | −1 | Severe Autism |
| 30 | B | −1.541269473 | −1 | Severe Autism |
| 31 | B | −1.538481467 | −1 | Severe Autism |
| 32 | B | −1.538416505 | −1 | Severe Autism |
| 33 | B | −1.534878217 | −1 | Severe Autism |
| 34 | B | −1.534385056 | −1 | Severe Autism |
| 35 | B | −1.533846688 | −1 | Severe Autism |
| 36 | B | −1.530096962 | −1 | Severe Autism |
| 37 | B | −1.529420298 | −1 | Severe Autism |
| 38 | B | −1.528728329 | −1 | Severe Autism |

TABLE 8.1d-continued

| No. | Group | FC_1 | LS | Loop Detected |
|---|---|---|---|---|
| 39 | B | −1.525128498 | −1 | Severe Autism |
| 40 | B | −1.521650132 | −1 | Severe Autism |
| 41 | B | −1.520003348 | −1 | Severe Autism |
| 42 | B | −1.519276092 | −1 | Severe Autism |
| 43 | B | −1.519266738 | −1 | Severe Autism |
| 44 | B | −1.51766574 | −1 | Severe Autism |
| 45 | B | −1.512705986 | −1 | Severe Autism |

TABLE 8.1d-continued

| No. | Group | FC_1 | LS | Loop Detected |
|---|---|---|---|---|
| 46 | B | −1.511278845 | −1 | Severe Autism |
| 47 | B | −1.508897319 | −1 | Severe Autism |
| 48 | B | −1.506127717 | −1 | Severe Autism |
| 49 | B | −1.504793078 | −1 | Severe Autism |
| 50 | B | −1.502283614 | −1 | Severe Autism |
| 51 | B | −1.502155169 | −1 | Severe Autism |

TABLE 8.1e

| No. | Group | Probe sequence 60 mer | Probe Location Chr |
|---|---|---|---|
| 1 | A | CATTTGCAGATTTGTTAATAGTATAAAATCGATTGGCCATATCCTTTCTTGCCCACCATA (SEQ ID NO: 1135) | 1 |
| 2 | A | TATTTTTCTTTATCTGAATTTATAACTTTCGATTTTTTTCATGCTCCTCTCCAATTCTGT (SEQ ID NO: 1118) | 5 |
| 3 | A | TTTAAACTGATAAGAACAGATATTACCCTCGAAATGTAGTAAGTAAAACCATAAAACTTT (SEQ ID NO: 1406) | 13 |
| 4 | A | AACAATAAATCCCTAATATCATCAAATATCGATTTTAGTATGACAACTAAGAACATAAAA (SEQ ID NO: 1143) | 15 |
| 5 | A | ACTCTTCAAAATTATAATTATCAACAATTCGATTTTGTTACTTGTTATTGGTCTTTTCAG (SEQ ID NO: 1100) | 10 |
| 6 | A | GGAAAGTATAAAATTCTGAATTTTCATGTCGACTTATGATTTTTCAACTTTATGATGGTG (SEQ ID NO: 1147) | 10 |
| 7 | A | AGTCCTTATTGAGTGATCTTTATATTACTCGAAAAACTCTTATCAGGATAAGAATAATGG (SEQ ID NO: 1138) | 1 |
| 8 | A | TTATATTGGAAATCTGTTTCAACAATAATCGATTCAGCATAAAATAAATGCAAATGAAAG (SEQ ID NO: 1351) | 6 |
| 9 | A | ATATTATGTTCTAGAAAAGGTAGAATTATCGAGATTTACTCATAGGCACTGAGTTTCAAA (SEQ ID NO: 1144) | 2 |
| 10 | A | AAAGTCATACAACTACTATGTAAGATATTCGAATTTGTGCTTGTTGGGAAAATAGTAATT (SEQ ID NO: 1409) | 9 |
| 11 | A | ATGGTAAGTTTTGGGAATTCAAAGAACCTCGATTCTCAGCTATATCCTTAATACTGGAAG (SEQ ID NO: 1336) | 12 |
| 12 | A | CTTAAAGCTGTCTAAATTTTATCTTAGTTCGAGGCCCTTTCAGGACTCTTTTCCTGGGGA (SEQ ID NO: 1375) | 19 |
| 13 | B | TTGGAAAAGGTAAATTGTGTTTTGTAAATCGAGTGATTTTTAGTTCTTCCAGACATAAAA (SEQ ID NO: 3614) | 6 |
| 14 | B | TAAAACTGGGATATTTGTTTTTCCTTGATCGAACACTCCAGACATACTAAATTAGAAATT (SEQ ID NO: 3615) | 15 |
| 15 | B | GATTACATAGAAATAGCCAATGGATTTATCGATAAACAGTTCCTATCATCAGCTATGGAG (SEQ ID NO: 3616) | 9 |
| 16 | B | CCTACCAGAACTCTTAAATCTATAATATTCGACTAACTCCTCCGTAAAGAATAGCTACCA (SEQ ID NO: 2286) | 4 |
| 17 | B | TAAAGTTTTGGAAGAAAATATTGGAAACTCGATATTTCTTAAAGCATGTCTACCTTCCAT (SEQ ID NO: 3618) | 8 |
| 18 | B | CTCCTTTGATGTAGTCATCAATGCCTTTTCGAAATTCCAAAAAACTGCATTTTTAGAACC (SEQ ID NO: 3619) | 5 |
| 19 | B | TTTTGTCCTAGTTGTAGCTTTTATAATTTCGAAAGATTCTTCCAGGCAGAGTTGCAGATT (SEQ ID NO: 3620) | 3 |
| 20 | B | GTTAAAATTATTTAAAATATTACACTTATCGACAGAAAAATCAAACTTCTGGTCATGGCT (SEQ ID NO: 3621) | 2 |
| 21 | B | ATGTGTTTTTCAAATTTTATCAAAAAGCTCGAGTCTTTTGTTTTTGTCAATAGTATTATT (SEQ ID NO: 3622) | 11 |

TABLE 8.1e-continued

| No. | Group | Probe sequence 60 mer | Probe Location Chr |
|-----|-------|------------------------|---------------------|
| 22 | B | AACCCCTCTGAGCAAATCTCCCACTGCCTCGACTTAACTGGAGGCTTGGTCCTTTCCGAG (SEQ ID NO: 3623) | 5 |
| 23 | B | AACCCCTCTGAGCAAATCTCCCACTGCCTCGACTTCCCGGAAATTCTGACCTGTAGCATT (SEQ ID NO: 3624) | 5 |
| 24 | B | TTTAAAATAGTGAATTTAAATTCATCCATCGACATTTCAAAAAAAAACCAGATCTGTCTT (SEQ ID NO: 3625) | 4 |
| 25 | B | AAATCCCTTCAATGGCTTTTTTTTTTTTTCGAAGCTTACTCTGAGTACCACCTCCTTCAG (SEQ ID NO: 3626) | 2 |
| 26 | B | TTGATGAGAGTTGATTCATAAGTTAATATCGAAGTTAGTGGTTAGACAAAATTTTGCTCT (SEQ ID NO: 3627) | 1 |
| 27 | B | AAAGTCATACAACTACTATGTAAGATATTCGAGGTGGGTCAATTTGTCAAATTAAAAGAA (SEQ ID NO: 3628) | 9 |
| 28 | B | TGTCAAATTCACCTTTTCAGTAGTAACTTCGACCCAATAAAATATCTCTAGGATGAGATA (SEQ ID NO: 3629) | 2 |
| 29 | B | TATTCTGTTGAATTGTTTTGGTTTTCTTTCGAAAGACTCCAAGACAGGAACAAGCGTGGC (SEQ ID NO: 3630) | 18 |
| 30 | B | ATTCTTAGTAAATTTGCATAATGTGGCATCGATAAAATTCTTCTCCGCCTTACTCACTCT (SEQ ID NO: 3631) | 2 |
| 31 | B | AACCGGTTTTGTCACAAACATTGAAAAATCGACGTTTATTTTATACAAACAATAAAGACA (SEQ ID NO: 3632) | 1 |
| 32 | B | AACCCCTCTGAGCAAATCTCCCACTGCCTCGAACCTCATGTTTAGGTGGTGGAAGCGAGT (SEQ ID NO: 3633) | 5 |
| 33 | B | TTTAAAATAGTGAATTTAAATTCATCCATCGAGAAATAAGGTACAAAAGTAGAAGAGAC (SEQ ID NO: 3634) | 4 |
| 34 | B | AATTACAAATAAAAGCCAATTCAATTTTTCGATTGAAAGAGGATGACGATTGTTTCCCTC (SEQ ID NO: 3635) | 8 |
| 35 | B | TTATTTAATCATTAATTTCCTCCTCTCGTCGAAGGTACAAATTGTTTTCAAATGGAAAGA (SEQ ID NO: 3636) | 2 |
| 36 | B | CTGCCTTTAGGGATAACATTTTACTGGTTCGACAAGTTAATCTTCCTAACAAGAATCACT (SEQ ID NO: 3637) | 2 |
| 37 | B | ATATTTAATGTCCTATATCTGCAGATATTCGACACGTGGTGACATGTGTAAGAAGTCCTG (SEQ ID NO: 3638) | 14 |
| 38 | B | AACCCCTCTGAGCAAATCTCCCACTGCCTCGAGGTTAATTTTTTCCCCTCTTAATAAGCG (SEQ ID NO: 3639) | 5 |
| 39 | B | ACTAGTTAACATTTCGTCTAAAATTTTATCGAGGAAGGCTAATGTTTTTTGATCTCTAAT (SEQ ID NO: 3640) | 13 |
| 40 | B | TCTTCATAGCTAAATGTATTACTAAGCTTCGAAAAAATTATTTAATTTGTGCTAACGTTA (SEQ ID NO: 3641) | 3 |
| 41 | B | CTATAGAAATTAAAATAATATTAAGAGTTCGAGTGATTCTTTAAAAATTGAACATTTCCA (SEQ ID NO: 3642) | 1 |
| 42 | B | AACCCCTCTGAGCAAATCTCCCACTGCCTCGATTTCCTCGCCTGTGAAATGGGAAATCAG (SEQ ID NO: 3643) | 5 |
| 43 | B | TATTTAGCTATAGTTTTTTCTCACTTTATCGAGTGATAGTCCAATTAGTTTATTTATAGG (SEQ ID NO: 3644) | 10 |
| 44 | B | TTGGAATTCATAGCAATTGCTGCTGCATTCGAAATCGGCAGAGTTTGTTCATTCAATTAG (SEQ ID NO: 3645) | 2 |
| 45 | B | TGTGCATCTTTTTTCTTTTTTTCTTTTTTCGAGTGAGTTGAGTTAAAATAATTCCGTAGG (SEQ ID NO: 3646) | 1 |
| 46 | B | TCTCTTCAGTCATTATTTAAACTACTTATCGATATCTGTTTACTTAACCACAAAGATAAC (SEQ ID NO: 3647) | 1 |
| 47 | B | AAAACTCAGGCTTTGCCACTGAGAGACCTCGAGGCCTCCACCCCTGCCCCGGAGAGAAAG (SEQ ID NO: 3648) | 2 |

TABLE 8.1e-continued

| No. | Group | Probe sequence 60 mer | Probe Location Chr |
|---|---|---|---|
| 48 | B | TGCTTTTGAACGGCTTTTAAAATAATTCTCGAGAGCTCTCATATGATTATTTGGGCTCAA (SEQ ID NO: 3649) | 6 |
| 49 | B | TCATAAAATAATAATTAACAAACATACATCGATGCCAAGTCTTTCTTCTGGTTTCTTTAT (SEQ ID NO: 3650) | 2 |
| 50 | B | AGACTTCATTTTCAAGCTTCAAATATTTTCGATTTTTAAAGATTTCCCCCAAGTGACTGA (SEQ ID NO: 3651) | 10 |
| 51 | B | ATGAAATATAAGTTTAAAAGATTGGAAATCGACAATGGGTTATTCAGGAATTTAAACTTT (SEQ ID NO: 3652) | 11 |

TABLE 8.1f

| No. | Group | Probe Location Start1 | End1 | Start2 | End2 | 4 kb Sequence Location Chr | Start1 |
|---|---|---|---|---|---|---|---|
| 1 | A | 181484004 | 181484033 | 181512003 | 181512032 | 1 | 181484004 |
| 2 | A | 68461136 | 68461165 | 68476887 | 68476916 | 5 | 68461136 |
| 3 | A | 110134293 | 110134322 | 110146404 | 110146433 | 13 | 110130323 |
| 4 | A | 65573796 | 65573825 | 65614349 | 65614378 | 15 | 65573796 |
| 5 | A | 76403648 | 76403677 | 76489184 | 76489213 | 10 | 76403648 |
| 6 | A | 80184352 | 80184381 | 80271930 | 80271959 | 10 | 80184352 |
| 7 | A | 103373640 | 103373669 | 103453557 | 103453586 | 1 | 103373640 |
| 8 | A | 154154479 | 154154508 | 154217496 | 154217525 | 6 | 154154479 |
| 9 | A | 87446098 | 87446127 | 87564889 | 87564918 | 2 | 87446098 |
| 10 | A | 28270700 | 28270729 | 28333746 | 28333775 | 9 | 28270700 |
| 11 | A | 30089467 | 30089496 | 30144612 | 30144641 | 12 | 30089467 |
| 12 | A | 29325559 | 29325588 | 29376363 | 29376392 | 19 | 29325559 |
| 13 | B | 47004709 | 47004738 | 47069677 | 47069706 | 6 | 47004709 |
| 14 | B | 76062977 | 76063006 | 76127904 | 76127933 | 15 | 76059007 |
| 15 | B | 94757875 | 94757904 | 94822711 | 94822740 | 9 | 94753905 |
| 16 | B | 37862801 | 37862830 | 37889309 | 37889338 | 4 | 37858831 |
| 17 | B | 41556028 | 41556057 | 41620526 | 41620555 | 8 | 41556028 |
| 18 | B | 53026200 | 53026229 | 53104497 | 53104526 | 5 | 53022230 |
| 19 | B | 10213512 | 10213541 | 10293573 | 10293602 | 3 | 10213512 |
| 20 | B | 104860981 | 104861010 | 104945455 | 104945484 | 2 | 104860981 |
| 21 | B | 49172115 | 49172144 | 49219787 | 49219816 | 11 | 49172115 |
| 22 | B | 14296088 | 14296117 | 14351874 | 14351903 | 5 | 14296088 |
| 23 | B | 14296088 | 14296117 | 14364875 | 14364904 | 5 | 14296088 |
| 24 | B | 151880270 | 151880299 | 151951299 | 151951328 | 4 | 151876300 |
| 25 | B | 42093752 | 42093781 | 42135670 | 42135699 | 2 | 42093752 |
| 26 | B | 98703844 | 98703873 | 98724117 | 98724146 | 1 | 98703844 |
| 27 | B | 28333746 | 28333775 | 28374829 | 28374858 | 9 | 28329776 |
| 28 | B | 169230824 | 169230853 | 169323242 | 169323271 | 2 | 169230824 |
| 29 | B | 61281291 | 61281320 | 61298115 | 61298144 | 18 | 61281291 |
| 30 | B | 68365938 | 68365967 | 68416817 | 68416846 | 2 | 68361968 |
| 31 | B | 229796283 | 229796312 | 229855687 | 229855716 | 1 | 229796283 |
| 32 | B | 14296088 | 14296117 | 14331607 | 14331636 | 5 | 14296088 |
| 33 | B | 151880270 | 151880299 | 152011204 | 152011233 | 4 | 151876300 |
| 34 | B | 101909210 | 101909239 | 101954515 | 101954544 | 8 | 101905240 |
| 35 | B | 71852414 | 71852443 | 71894829 | 71894858 | 2 | 71848444 |
| 36 | B | 122391995 | 122392024 | 122423623 | 122423652 | 2 | 122388025 |
| 37 | B | 99818383 | 99818412 | 99886666 | 99886695 | 14 | 99814413 |
| 38 | B | 14296088 | 14296117 | 14319860 | 14319889 | 5 | 14296088 |
| 39 | B | 50679894 | 50679923 | 50716473 | 50716502 | 13 | 50679894 |
| 40 | B | 84117115 | 84117144 | 84159751 | 84159780 | 3 | 84113145 |
| 41 | B | 152809337 | 152809366 | 152824655 | 152824684 | 1 | 152805367 |
| 42 | B | 14296088 | 14296117 | 14334111 | 14334140 | 5 | 14296088 |
| 43 | B | 23013442 | 23013471 | 23046339 | 23046368 | 10 | 23009472 |
| 44 | B | 122422501 | 122422530 | 122491445 | 122491474 | 2 | 122418531 |
| 45 | B | 98688891 | 98688920 | 98709471 | 98709500 | 1 | 98684921 |
| 46 | B | 116956489 | 116956518 | 117001586 | 117001615 | 1 | 116952519 |
| 47 | B | 104614224 | 104614253 | 104659697 | 104659726 | 2 | 104614224 |
| 48 | B | 152926117 | 152926146 | 153001410 | 153001439 | 6 | 152926117 |
| 49 | B | 38155445 | 38155474 | 38175851 | 38175880 | 2 | 38151475 |
| 50 | B | 104242088 | 104242117 | 104311372 | 104311401 | 10 | 104238118 |
| 51 | B | 86195749 | 86195778 | 86254977 | 86255006 | 11 | 86195749 |

TABLE 8.1g

| | | 4 kb Sequence Location | | |
|---|---|---|---|---|
| No. | Group | End1 | Start2 | End2 | Probe |

| No. | Group | End1 | Start2 | End2 | Probe |
|---|---|---|---|---|---|
| 1 | A | 181488003 | 181508033 | 181512032 | ORF130_1_181484002_181486199_181499646_181512034_RF |
| 2 | A | 68465135 | 68476887 | 68480886 | ORF121_5_68461134_68466125_68476885_68484945_RR |
| 3 | A | 110134322 | 110146404 | 110150403 | ORF197_13_110131405_110134324_110146402_110150942_FR |
| 4 | A | 65577795 | 65610379 | 65614378 | ORF138_15_65573794_65596309_65611369_65614380_RF |
| 5 | A | 76407647 | 76489184 | 76493183 | ORF11_10_76403646_76410014_76489182_76492128_RR |
| 6 | A | 80188351 | 80267960 | 80271959 | ORF14_10_80184350_80188816_80268946_80271961_RF |
| 7 | A | 103377639 | 103449587 | 103453586 | ORF133_1_103373638_103377704_103450404_103453588_RF |
| 8 | A | 154158478 | 154217496 | 154221495 | ORF16_6_154154477_154163186_154217494_154220454_RR |
| 9 | A | 87450097 | 87560919 | 87564918 | ORF138_2_87446096_87451261_87563076_87564920_RF |
| 10 | A | 28274699 | 28329776 | 28333775 | ORF198_9_28270698_28275294_28314155_28333777_RF |
| 11 | A | 30093466 | 30144612 | 30148611 | ORF151_12_30089465_30094558_30144610_30146709_RR |
| 12 | A | 29329558 | 29376363 | 29380362 | ORF175_19_29325557_29328725_29376361_29378170_RR |
| 13 | B | 47008708 | 47065707 | 47069706 | ORF198_6_47004707_47060758_47069706_RF |
| 14 | B | 76063006 | 76127904 | 76131903 | ORF161_15_76059101_76063008_76127902_76129439_FR |
| 15 | B | 94757904 | 94818741 | 94822740 | ORF18_9_94753448_94757906_94818790_94822742_FF |
| 16 | B | 37862830 | 37889309 | 37893308 | ORF19_4_37859966_37862832_37889307_37892348_FR |
| 17 | B | 41560027 | 41620526 | 41624525 | ORF115_8_41556026_41557719_41620524_41625614_RR |
| 18 | B | 53026229 | 53104497 | 53108496 | ORF18_5_53020744_53026231_53104495_53107169_FR |
| 19 | B | 10217511 | 10289603 | 10293602 | ORF13_3_10213510_10218995_10289864_10293604_RF |
| 20 | B | 104864980 | 104945455 | 104949454 | ORF16_2_104860979_104864045_104945453_104950314_RR |
| 21 | B | 49176114 | 49215817 | 49219816 | ORF19_11_49172113_49174734_49215817_49219818_RF |
| 22 | B | 14300087 | 14351874 | 14355873 | ORF138_5_14296086_14298950_14351872_14353515_RR |
| 23 | B | 14300087 | 14364875 | 14368874 | ORF191_5_14296086_14298950_14364873_14369388_RR |
| 24 | B | 151880299 | 151947329 | 151951328 | ORF11_4_151874649_151880301_151939544_151951330_FF |
| 25 | B | 42097751 | 42135670 | 42139669 | ORF170_2_42093750_42101196_42135668_42138124_RR |
| 26 | B | 98707843 | 98720147 | 98724146 | ORF186_1_98703842_98709502_98720841_98724148_RF |
| 27 | B | 28333775 | 28370859 | 28374858 | ORF197_9_28314155_28333777_28371887_28374860_FF |
| 28 | B | 169234823 | 169319272 | 169323271 | ORF121_2_169230822_169232519_169312990_169323273_RF |
| 29 | B | 61285290 | 61298115 | 61302114 | ORF196_18_61281289_61284639_61298113_61302116_RR |
| 30 | B | 68365967 | 68412847 | 68416846 | ORF187_2_68359452_68365969_68410496_68416848_FF |
| 31 | B | 229800282 | 229851717 | 229855716 | ORF147_1_229796281_229797522_229849427_229855718_RF |
| 32 | B | 14300087 | 14331607 | 14335606 | ORF180_5_14296086_14298950_14331605_14334109_RR |
| 33 | B | 151880299 | 152011204 | 152015203 | ORF18_4_151874649_151880301_152011202_152016397_FR |
| 34 | B | 101909239 | 101950545 | 101954544 | ORF196_8_101906298_101909241_101944527_101954546_FF |
| 35 | B | 71852443 | 71890859 | 71894858 | ORF158_2_71849462_71852445_71889643_71894860_FF |
| 36 | B | 122392024 | 122423623 | 122427622 | ORF1_2_122384211_122392026_122423621_122431761_FR |
| 37 | B | 99818412 | 99882696 | 99886695 | ORF18_14_99815362_99818414_99884900_99886697_FF |
| 38 | B | 14300087 | 14319860 | 14323859 | ORF143_5_14296086_14298950_14323303_RR |
| 39 | B | 50683893 | 50716473 | 50720472 | ORF168_13_50679892_50686027_50716471_50721185_RR |
| 40 | B | 84117144 | 84155781 | 84159780 | ORF143_84107388_84117146_84158429_84159782_FF |
| 41 | B | 152809366 | 152824655 | 152828654 | ORF103_1_152785124_152809368_152824653_152831895_FR |
| 42 | B | 14300087 | 14334111 | 14338110 | ORF176_5_14296086_14298950_14331762_RR |
| 43 | B | 23013471 | 23046339 | 23050338 | ORF14_10_23011505_23013473_23046337_23050583_FR |
| 44 | B | 122422530 | 122487475 | 122491474 | ORF106_2_122420370_122422532_122487405_122491476_FF |
| 45 | B | 98688920 | 98705501 | 98709500 | ORF199_1_98683897_98688922_98703842_98709502_FF |
| 46 | B | 116956518 | 117001586 | 117005585 | ORF184_1_116953472_117001584_117004481_FR |
| 47 | B | 104618223 | 104659697 | 104663696 | ORF147_2_104614222_104616408_104659695_104660711_RR |
| 48 | B | 152930116 | 153001410 | 153005409 | ORF14_6_152926115_152930237_153001408_153002544_RR |
| 49 | B | 38155474 | 38171881 | 38175880 | ORF158_2_38148629_38155476_38173151_38175882_FF |
| 50 | B | 104242117 | 104307402 | 104311401 | ORF123_10_104238473_104242119_104302206_104311403_FF |
| 51 | B | 86199748 | 86251007 | 86255006 | ORF16_11_86195747_86200973_86253845_86255008_RF |

TABLE 8.1h

| No. | | PCR-GroupPrimer1_ID | PCR_Primer1 | PCR-Primer2_ID | PCR_Primer2 |
|---|---|---|---|---|---|
| 1 | A | OBD159_917 | GCGTTGGAGAAGACCTCAGCCAT (SEQ ID NO: 1217) | OBD159_919 | AAACGGGTCTCCACGGCACCAAG (SEQ ID NO: 1299) |
| 2 | A | OBD159_849 | CAGTGGTAATCTATGGGTGGTAGGAA (SEQ ID NO: 1200) | OBD159_851 | GGTGACTGACAGCCAAATCCAATGGG (SEQ ID NO: 1282) |
| 3 | A | OBD159_1345 | AGAATGGGTCTTACTTTGAAAATA (SEQ ID NO: 1488) | OBD159_1347 | CTTTTATTTTAGATACAGTGGTGT (SEQ ID NO: 1570) |
| 4 | A | OBD159_949 | TCACCCAGTTTCTGCTGTCAATGC (SEQ ID NO: 1225) | OBD159_951 | ATCAGTGTTTTCTCCTCTCAAATA (SEQ ID NO: 1307) |
| 5 | A | OBD159_777 | ACAAAATAGAACCCTGGTCCCACC (SEQ ID NO: 1182) | OBD159_779 | GGAAAATCTAAAAGTAATGGACAAA (SEQ ID NO: 1264) |
| 6 | A | OBD159_965 | GCATAGGGTAGTTGCTCCTTGAGTTT (SEQ | OBD159_967 | ACACGGTCCCTGACTCAAGATGGTTG |

TABLE 8.1h-continued

| No. | PCR-GroupPrimer1_ID | PCR_Primer1 | PCR-Primer2_ID | PCR_Primer2 |
|---|---|---|---|---|
| | | ID NO: 1229) | | (SEQ ID NO: 1311) |
| 7 | A | OBD159_929 | GTGTTCATTACCTGATTTGATTTA (SEQ NO: 1220) | OBD159_931 | TCTTATTTCCCAAGGCTCAAAAGC (SEQ ID NO: 1302) |
| 8 | A | OBD159_1125 | TGGCAGTCATCAAAATCGCTTCTA (SEQ NO: 1433) | OBD159_1127 | CAGACAAAGCAAAAGATTTCCTAT (SEQ ID NO: 1515) |
| 9 | A | OBD159_953 | AATGAACTATCAGGCTATGTAAAA (SEQ NO: 1226) | OBD159_955 | TACAGTATTTGAGTCACAGGCTGC (SEQ ID NO: 1308) |
| 10 | A | OBD159_1357 | GAAAACCAGTCAATCCTCAAGTGTGC (SEQ ID NO: 1491) | OBD159_1359 | CTCAAGTCCTCATCTGTAGAGTCTGG (SEQ ID NO: 1573) |
| 11 | A | OBD159_1065 | AGGCTTCCTTGTTGTGTTCATAAT (SEQ ID NO: 1418) | OBD159_1067 | TTCTTCCCTCAGCCATCCATTTGG (SEQ ID NO: 1500) |
| 12 | A | OBD159_1221 | AGATGTGTGTGGGCTCTCGGGCT (SEQ ID NO: 1457) | OBD159_1223 | GTCACCGTCCCCAGCAAGAAAGA (SEQ ID NO: 1539) |
| 13 | B | OBD159_3649 | GAGATGGGTTGCTGGCTGGAGTCTTCTG (SEQ ID NO: 3665) | OBD159_3651 | CTGCCCTTGTATTTCTGACTCCGTAACC (SEQ ID NO: 3716) |
| 14 | B | OBD159_3653 | GGGAGCATCACTATCTTCTTCAGTTGGG (SEQ ID NO: 3666) | OBD159_3655 | GCAGCCATTCCACTTGACCCTCTGTATC (SEQ ID NO: 3717) |
| 15 | B | OBD159_3657 | GCCACAGCCACCATCAGAATGAAGTT (SEQ ID NO: 3667) | OBD159_3659 | TCATCTCAGTTGCTTTCTGCTGGAGC (SEQ ID NO: 3423) |
| 16 | B | OBD159_3661 | CTTACAGCCTTCCAAAATAACTCCAG (SEQ ID NO: 950) | OBD159_3663 | ATGGCATTCCCTGATTTCCCTGGATG (SEQ ID NO: 2506) |
| 17 | B | OBD159_3665 | TCTTACATCACACCACATCCCCAAAT (SEQ ID NO: 3669) | OBD159_3667 | TGGCACTCTCACCAAGACAACCTCAG (SEQ ID NO: 3720) |
| 18 | B | OBD159_3669 | CACCAATCCCTACATTTTCATCCTCA (SEQ ID NO: 3670) | OBD159_3671 | AAGAAAGGAGCAAGCCAAGGATGCCT (SEQ ID NO: 3721) |
| 19 | B | OBD159_3673 | TCTGTTGCGGGTCTCTTGAGGGC (SEQ ID NO: 3671) | OBD159_3675 | GACTGGGCACACAGGAAGCACTA (SEQ ID NO: 3722) |
| 20 | B | OBD159_3677 | CCTGGAACTTGGGCAAACTAAACTCC (SEQ ID NO: 1213) | OBD159_3679 | GAACTCCAAACACATACCCCTGACAG (SEQ ID NO: 3723) |
| 21 | B | OBD159_3681 | GAGCAGGAAAGTCAAAGGAAAGGAGG (SEQ ID NO: 3673) | OBD159_3683 | GCCAAAGAAATGGAATGCTGATGAAT (SEQ ID NO: 3724) |
| 22 | B | OBD159_3685 | GTGCGGGATTCAGACCTTCAGCA (SEQ ID NO: 3674) | OBD159_3687 | ACTACCTGGAAAGGGAGACCCCG (SEQ ID NO: 3725) |
| 23 | B | OBD159_3689 | GGTGCGGGATTCAGACCTTCAGC (SEQ ID NO: 3675) | OBD159_3691 | GCAGGCACAATCCTTCCCAATGC (SEQ ID NO: 3726) |
| 24 | B | OBD159_3693 | GCTATCTATCACTCAGGGCTTTCCAGGG (SEQ ID NO: 3676) | OBD159_3695 | GCCTTGGCTACGGACTGTCAACTCAGC (SEQ ID NO: 3727) |
| 25 | B | OBD159_3697 | TCCATCCTTCTCACAGCAGCCAAGAG (SEQ ID NO: 3677) | OBD159_3699 | GGGATTGAGCAGACAGATTAGTGAAA (SEQ ID NO: 3728) |
| 26 | B | OBD159_3701 | TATTTTTCCTGATTGTAAAGTAAAT (SEQ ID NO: 3678) | OBD159_3703 | GATTTCCCAACTCAGTTAAAAA (SEQ ID NO: 3729) |
| 27 | B | OBD159_3705 | TGAAAACCAGTCAATCCTCAAGTGTGC (SEQ ID NO: 3679) | OBD159_3707 | AACCAGAGCCCCAAATAAGGATGGAAGC (SEQ ID NO: 3730) |
| 28 | B | OBD159_3709 | GGGGAAATGTTGCAATTAACTAATTTT (SEQ ID NO: 3680) | OBD159_3711 | TTAACTATTGGTTATAAGAATAAA (SEQ ID NO: 3731) |
| 29 | B | OBD159_3713 | TGGTATTGCTCCACTTCTGGCACTGC (SEQ ID NO: 3681) | OBD159_3715 | AACAGTCTTCTTCCTGCCTCACTACT (SEQ ID NO: 3732) |
| 30 | B | OBD159_3717 | CTCTTCTATGGAGGTTTCTTGGAGGGAC (SEQ ID NO: 3682) | OBD159_3719 | CAGTGGGCAGAAGGGCGGGTTACAGC (SEQ ID NO: 3733) |
| 31 | B | OBD159_3721 | CCACCGATTTATTGCCCTGTAGGACA (SEQ ID NO: 1322) | OBD159_3723 | GATTGATGAAGTGGAAGTGGCAGGCA (SEQ ID NO: 3734) |

TABLE 8.1h-continued

| No. | PCR-GroupPrimer1_ID | PCR_Primer1 | PCR-Primer2_ID | PCR_Primer2 |
|---|---|---|---|---|
| 32 | B | OBD159_3725 | GGTGCGGGATTCAGACCTTCAGC (SEQ NO: 3675) | OBD159_3727 | CAAGTGCTTCCTGAGGTGACTGC (SEQ ID NO: 3735) |
| 33 | B | OBD159_3729 | GCTATCTATCACTCAGGGCTTTCCAGGG (SEQ ID NO: 3676) | OBD159_3731 | CCCATCCTAAAGTGACTGAACGGCAGCA (SEQ ID NO: 3736) |
| 34 | B | OBD159_3733 | GAGCCCATCAGAGCACCCATTCT (SEQ ID NO: 3686) | OBD159_3735 | CTGACCTCTCCTGGCTTCCTGCT (SEQ ID NO: 3737) |
| 35 | B | OBD159_3737 | GCATCTCCGCCGCCTACTTGGGC (SEQ ID NO: 3687) | OBD159_3739 | TCTCACCCCTCCCCAGGATGGCTCCACT (SEQ ID NO: 3738) |
| 36 | B | OBD159_3741 | GGAATCCAGCCAAGGGAGGCATTAGGAC (SEQ ID NO: 3688) | OBD159_3743 | GAGAGAGCAACAGAGGGCAGGGTCCC (SEQ ID NO: 3739) |
| 37 | B | OBD159_3745 | CCAAACCAAGGAGGTGACAATGGAGG (SEQ ID NO: 3689) | OBD159_3747 | GGACTCCTCCTCTATCAAGCCTTATT (SEQ ID NO: 3740) |
| 38 | B | OBD159_3749 | GTGCGGGATTCAGACCTTCAGCA (SEQ ID NO: 3674) | OBD159_3751 | CGCCACGCCTGACTACCATCCAA (SEQ ID NO: 3741) |
| 39 | B | OBD159_3753 | TCACTGGCATTCATAGATGTGGTCAC (SEQ ID NO: 3691) | OBD159_3755 | GACATCACGGAAAAGGTAGCCCAAGG (SEQ ID NO: 3742) |
| 40 | B | OBD159_3757 | CTCCCCTACCTTTTCCTGCCTTCTTC (SEQ ID NO: 3692) | OBD159_3759 | TCAGAACCAGGCAGAGCCAATGAAAA (SEQ ID NO: 3743) |
| 41 | B | OBD159_3761 | GACATTTGGTGACCCATTACTCAACA (SEQ ID NO: 82) | OBD159_3763 | GCTATGAGGCAAATCAAAAGTAAAGC (SEQ ID NO: 3744) |
| 42 | B | OBD159_3765 | GGTGCGGGATTCAGACCTTCAGC (SEQ ID NO: 3675) | OBD159_3767 | GCCTCACAAAAGCGGCAGGACAT (SEQ ID NO: 3745) |
| 43 | B | OBD159_3769 | CCTGGAATAGCCTTGCTTGTTTTGTGGC (SEQ ID NO: 3695) | OBD159_3771 | GCTTTCTATCCTGTAAGAGTCTATGC (SEQ ID NO: 3746) |
| 44 | B | OBD159_3773 | GTTGAGGGTGAAGGCTAACAGTTTTGAG (SEQ ID NO: 3696) | OBD159_3775 | GGGAAAAGGCAAGCACCGCTCTCAGC (SEQ ID NO: 3747) |
| 45 | B | OBD159_3777 | CCCAGTTATTTCTACAGTTTGGAAGC (SEQ ID NO: 3697) | OBD159_3779 | CCTGCTTCTGAGACCTCCACAGTGTT (SEQ ID NO: 3748) |
| 46 | B | OBD159_3781 | CCGCTGTGTTTGGGTATGTAGGATTC (SEQ ID NO: 3698) | OBD159_3783 | GGTTGAGTGACAAATGCTGTGCTCTC (SEQ ID NO: 3749) |
| 47 | B | OBD159_3785 | GGAGGAAGCCCAGCCACTTGAGT (SEQ ID NO: 3699) | OBD159_3787 | CAGCAGAAATCTCTCCCTCAGGC (SEQ ID NO: 3750) |
| 48 | B | OBD159_3789 | GAAGAGGAGGTATTCCACTGTCTGAA (SEQ ID NO: 3700) | OBD159_3791 | GGTTTCTGGCTTCAGCACGAGTGGTA (SEQ ID NO: 3751) |
| 49 | B | OBD159_3793 | GCTCTGCCTTTCATTTACACACAGGA (SEQ ID NO: 3701) | OBD159_3795 | GGTCTGTGATTTGGTGGCTGCGTGAA (SEQ ID NO: 3752) |
| 50 | B | OBD159_3797 | GGGAAGAGGCTACATTGTTATGGATA (SEQ ID NO: 3702) | OBD159_3799 | CAGGCTCATTGGCTTTTCCCAGGTCT (SEQ ID NO: 3753) |
| 51 | B | OBD159_3801 | AGAGACAGGGTTTCACCATATTGGCCAGGA (SEQ ID NO: 3703) | OBD159_3803 | GAAGATATTTTGTTATTTCCAA (SEQ ID NO: 3754) |

TABLE 8.2a

| No. | Group | Probe | GeneLocus | Probe_Count_Total |
|---|---|---|---|---|
| 52 | B | ORF13_11_87926403_87934326_87969207_88006264_FF | N/A | N/A |
| 53 | B | ORF107_5_14296086_14298950_14319858_14323303_RR | N/A | N/A |
| 54 | B | ORF122_14_85582584_85584999_85612892_85619304_RR | N/A | N/A |
| 55 | B | ORF18_1_177061512_177062775_177182650_177184039_RF | N/A | N/A |
| 56 | B | ORF10_18_10266375_10268783_10331127_10332730_FR | N/A | N/A |
| 57 | B | ORF175_18_28083723_28088432_28142420_28147707_FR | N/A | N/A |
| 58 | B | ORF186_15_89407225_89408856_89469667_89472380_FF | N/A | N/A |
| 59 | B | ORF18_1_246640282_246644196_246664999_246668825_RR | N/A | N/A |
| 60 | B | ORF10_2_66470757_66475654_66592400_66595314_FR | N/A | N/A |

TABLE 8.2a-continued

| No. | Group | Probe | GeneLocus | Probe_Count_Total |
|-----|-------|-------|-----------|-------------------|
| 61 | B | ORF13_6_168253924_168260809_168295264_168300543_RF | N/A | N/A |
| 62 | B | ORF171_9_8138555_8143223_8167171_8181381_FR | N/A | N/A |
| 63 | B | ORF153_1_116579148_116582139_116593950_116598324_FR | N/A | N/A |
| 64 | B | ORF11_16_75911508_75913466_75948233_75952817_FR | N/A | N/A |
| 65 | B | ORF112_3_116555344_116556412_116607020_116611600_RR | N/A | N/A |
| 66 | B | ORF150_1_111535220_111538688_111567009_111572658_RF | N/A | N/A |
| 67 | B | ORF148_3_64194265_64195323_64266976_64268244_FR | N/A | N/A |
| 68 | B | ORF185_6_139965927_139972052_140005899_140012028_RF | N/A | N/A |
| 69 | B | ORF172_2_197111951_197117459_197161229_197162625_RR | N/A | N/A |
| 70 | B | ORF16_16_51538978_51545978_51556847_51564565_RF | N/A | N/A |
| 71 | B | ORF100_2_102942687_102944341_102983000_102995309_FR | N/A | N/A |
| 72 | B | ORF16_12_134194_137994_79804_82702_RR | N/A | N/A |
| 73 | B | ORF133_4_109570279_109575929_109606195_109611946_RF | N/A | N/A |
| 74 | B | ORF123_22_26723696_26728605_26756491_26757562_RF | N/A | N/A |
| 75 | B | ORF157_8_29047786_29048949_29063470_29065562_FR | N/A | N/A |
| 76 | B | ORF185_6_114223082_114225950_114291528_114299574_RR | N/A | N/A |
| 77 | C | ORF138_12_81301126_81306761_81329842_81332845_RR | N/A | N/A |
| 78 | C | ORF125_4_152168385_152172738_152221305_152227696_FF | N/A | N/A |
| 79 | C | ORF185_19_52224152_52228867_52265664_52267714_RF | N/A | N/A |
| 80 | C | ORF173_8_86595631_86604532_86648386_86651477_RR | N/A | N/A |
| 81 | C | ORF10_2_120634320_120644277_120657582_120661506_FF | N/A | N/A |
| 82 | C | ORF100_6_27443471_27448356_27474081_27477940_RF | N/A | N/A |
| 83 | C | ORF17_12_13672704_13680228_13723880_13729648_RR | N/A | N/A |
| 84 | C | ORF18_5_149610432_149612632_149663575_149665859_RR | N/A | N/A |
| 85 | C | ORF136_2_98173571_98177804_98209752_98213279_FR | N/A | N/A |
| 86 | C | ORF151_5_136165905_136172620_136234001_136237401_FF | N/A | N/A |
| 87 | C | ORF182_2_198099686_198102962_198137324_198146976_RR | N/A | N/A |
| 88 | C | ORF171_14_68293666_68299109_68325745_68327713_RF | N/A | N/A |
| 89 | C | ORF108_2_209644804_209647666_209684451_209692640_RF | N/A | N/A |
| 90 | C | ORF160_4_152757074_152760709_152780762_152787205_RF | N/A | N/A |
| 91 | C | ORF127_7_8358874_8360456_8389864_8393728_RR | N/A | N/A |
| 92 | C | ORF145_5_14296086_14298950_14351872_14353515_RR | N/A | N/A |
| 93 | C | ORF124_12_130248318_130252496_130274212_130276586_FF | N/A | N/A |
| 94 | C | ORF114_5_14296086_14298950_14334109_14335762_RR | N/A | N/A |
| 95 | C | ORF134_2_2294551_2296479_2317980_2323920_FR | N/A | N/A |
| 96 | C | ORF198_12_130189601_130192155_130248318_130252496_RR | N/A | N/A |
| 97 | C | ORF164_10_85560664_85563397_85593191_85595358_RR | N/A | N/A |
| 98 | C | ORF132_5_107295107_107306594_107372426_107377048_RF | N/A | N/A |
| 99 | C | ORF135_14_29277224_29280917_29340222_29341759_RF | N/A | N/A |
| 100 | C | ORF118_15_68642931_68645237_68673635_68679559_RF | N/A | N/A |
| 101 | C | ORF123_5_14296086_14298950_14364873_14369388_RR | N/A | N/A |
| 102 | C | ORF103_5_14296086_14298950_14331605_14334109_RR | N/A | N/A |

TABLE 8.2b

| No. | Group | Probe_Count_Sig | HyperG_Stats | FDR_HyperG | Percent_Sig | logFC | AveExpr |
|-----|-------|-----------------|--------------|------------|-------------|-------|---------|
| 52 | B | N/A | N/A | N/A | N/A | −0.586898321 | −0.586898321 |
| 53 | B | N/A | N/A | N/A | N/A | −0.586827812 | −0.586827812 |
| 54 | B | N/A | N/A | N/A | N/A | −0.586051104 | −0.586051104 |
| 55 | B | N/A | N/A | N/A | N/A | −0.584927271 | 0.584927271 |
| 56 | B | N/A | N/A | N/A | N/A | −0.584684418 | −0.584684418 |
| 57 | B | N/A | N/A | N/A | N/A | −0.583908766 | −0.583908766 |
| 58 | B | N/A | N/A | N/A | N/A | −0.582395639 | −0.582395639 |
| 59 | B | N/A | N/A | N/A | N/A | −0.581165242 | −0.581165242 |
| 60 | B | N/A | N/A | N/A | N/A | −0.580915659 | −0.580915659 |
| 61 | B | N/A | N/A | N/A | N/A | −0.580259909 | −0.580259909 |
| 62 | B | N/A | N/A | N/A | N/A | −0.57904454 | −0.57904454 |
| 63 | B | N/A | N/A | N/A | N/A | −0.578157078 | −0.578157078 |
| 64 | B | N/A | N/A | N/A | N/A | −0.577141251 | −0.577141251 |
| 65 | B | N/A | N/A | N/A | N/A | −0.575549154 | −0.575549154 |
| 66 | B | N/A | N/A | N/A | N/A | −0.574427555 | −0.574427555 |
| 67 | B | N/A | N/A | N/A | N/A | −0.57288621 | 0.57288621 |
| 68 | B | N/A | N/A | N/A | N/A | −0.572175196 | −0.572175196 |
| 69 | B | N/A | N/A | N/A | N/A | −0.570805397 | 0.570805397 |
| 70 | B | N/A | N/A | N/A | N/A | −0.569367362 | −0.569367362 |
| 71 | B | N/A | N/A | N/A | N/A | −0.567678147 | −0.567678147 |
| 72 | B | N/A | N/A | N/A | N/A | −0.567184946 | −0.567184946 |
| 73 | B | N/A | N/A | N/A | N/A | −0.56711622 | −0.56711622 |
| 74 | B | N/A | N/A | N/A | N/A | −0.566444933 | −0.566444933 |
| 75 | B | N/A | N/A | N/A | N/A | −0.565375444 | 0.565375444 |
| 76 | B | N/A | N/A | N/A | N/A | −0.564634919 | −0.564634919 |
| 77 | C | N/A | N/A | N/A | N/A | −0.702767919 | −0.702767919 |
| 78 | C | N/A | N/A | N/A | N/A | −0.698964773 | −0.698964773 |
| 79 | C | N/A | N/A | N/A | N/A | −0.696908521 | −0.696908521 |

TABLE 8.2b-continued

| No. | Group | Probe_Count_Sig | HyperG_Stats | FDR_HyperG | Percent_Sig | logFC | AveExpr |
|---|---|---|---|---|---|---|---|
| 80 | C | N/A | N/A | N/A | N/A | −0.696509019 | −0.696509019 |
| 81 | C | N/A | N/A | N/A | N/A | −0.690656622 | −0.690656622 |
| 82 | C | N/A | N/A | N/A | N/A | −0.690344952 | −0.690344952 |
| 83 | C | N/A | N/A | N/A | N/A | −0.684415014 | −0.684415014 |
| 84 | C | N/A | N/A | N/A | N/A | −0.683595798 | −0.683595798 |
| 85 | C | N/A | N/A | N/A | N/A | −0.683573062 | −0.683573062 |
| 86 | C | N/A | N/A | N/A | N/A | −0.68352752 | −0.68352752 |
| 87 | C | N/A | N/A | N/A | N/A | −0.67957191 | −0.67957191 |
| 88 | C | N/A | N/A | N/A | N/A | −0.673242334 | −0.673242334 |
| 89 | C | N/A | N/A | N/A | N/A | −0.668516451 | −0.668516451 |
| 90 | C | N/A | N/A | N/A | N/A | −0.663486882 | −0.663486882 |
| 91 | C | N/A | N/A | N/A | N/A | −0.66262386 | 0.66262386 |
| 92 | C | N/A | N/A | N/A | N/A | −0.661216696 | −0.661216696 |
| 93 | C | N/A | N/A | N/A | N/A | −0.660275172 | −0.660275172 |
| 94 | C | N/A | N/A | N/A | N/A | −0.658216308 | −0.658216308 |
| 95 | C | N/A | N/A | N/A | N/A | −0.656777859 | −0.656777859 |
| 96 | C | N/A | N/A | N/A | N/A | −0.653345364 | −0.653345364 |
| 97 | C | N/A | N/A | N/A | N/A | −0.652291019 | −0.652291019 |
| 98 | C | N/A | N/A | N/A | N/A | −0.650225719 | −0.650225719 |
| 99 | C | N/A | N/A | N/A | N/A | −0.649623586 | −0.649623586 |
| 100 | C | N/A | N/A | N/A | N/A | −0.648661823 | −0.648661823 |
| 101 | C | N/A | N/A | N/A | N/A | −0.644293882 | −0.644293882 |
| 102 | C | N/A | N/A | N/A | N/A | −0.640456524 | −0.640456524 |

TABLE 8.2c

| No. | Group | t | P.Value | adj.P.Val | B | FC |
|---|---|---|---|---|---|---|
| 52 | B | −5.395369562 | 0.000162149 | 0.001167317 | 0.758034728 | 0.665772728 |
| 53 | B | −9.155938388 | 0.000000931 | 0.0000383 | 6.077783362 | 0.665805267 |
| 54 | B | −4.252417142 | 0.001126266 | 0.004875795 | −1.234133935 | 0.666163815 |
| 55 | B | −12.68957312 | 0.0000000263 | 0.00000482 | 9.673892039 | 0.666682947 |
| 56 | B | −10.64975836 | 0.000000183 | 0.0000142 | 7.731630617 | 0.666795181 |
| 57 | B | −7.583585093 | 0.00000653 | 0.000131431 | 4.076805415 | 0.667153773 |
| 58 | B | −4.385539898 | 0.000890811 | 0.004095481 | −0.99425845 | 0.667853865 |
| 59 | B | −8.108130314 | 0.00000331 | 0.0000844 | 4.777078763 | 0.668423684 |
| 60 | B | −4.274667755 | 0.00108281 | 0.004732596 | −1.193919829 | 0.66853933 |
| 61 | B | −10.24766131 | 0.000000278 | 0.0000183 | 7.307670683 | 0.668843271 |
| 62 | B | −11.6199294 | 0.0000000702 | 0.00000804 | 8.696644406 | 0.669406962 |
| 63 | B | −7.93551324 | 0.00000412 | 0.0000975 | 4.550417934 | 0.669818868 |
| 64 | B | −9.216088835 | 0.000000869 | 0.0000367 | 6.14872636 | 0.670290666 |
| 65 | B | −7.440743794 | 0.00000790 | 0.000148427 | 3.880068379 | 0.671030779 |
| 66 | B | −13.42437933 | 0.0000000140 | 0.00000340 | 10.29841244 | 0.671552663 |
| 67 | B | −6.245767362 | 0.0000431 | 0.00045868 | 2.127000784 | 0.672270519 |
| 68 | B | −7.12134428 | 0.0000122 | 0.000198377 | 3.430489476 | 0.672601921 |
| 69 | B | −7.088625782 | 0.0000128 | 0.000204264 | 3.383670075 | 0.673240841 |
| 70 | B | −7.524455646 | 0.00000706 | 0.000137939 | 3.995685688 | 0.673912242 |
| 71 | B | −14.84926608 | 0.00000000445 | 0.00000192 | 11.41310563 | 0.674701771 |
| 72 | B | −10.21791369 | 0.000000287 | 0.0000186 | 7.27571193 | 0.674932464 |
| 73 | B | −9.533328384 | 0.000000606 | 0.0000292 | 6.516570726 | 0.674964617 |
| 74 | B | −5.764018355 | 0.0000902 | 0.00076953 | 1.364008245 | 0.675278751 |
| 75 | B | −10.96015665 | 0.000000134 | 0.0000117 | 8.048992793 | 0.67577953 |
| 76 | B | −7.361075142 | 0.00000880 | 0.000159439 | 3.769187822 | 0.676126492 |
| 77 | C | −10.48346697 | 0.000000217 | 0.0000158 | 7.558089961 | 0.614392317 |
| 78 | C | −7.705331156 | 0.00000556 | 0.000118449 | 4.242417809 | 0.616014078 |
| 79 | C | −7.679506884 | 0.00000575 | 0.000121229 | 4.207446703 | 0.6168927 |
| 80 | C | −6.039894092 | 0.0000589 | 0.000570983 | 1.804960079 | 0.617063549 |
| 81 | C | −5.295901523 | 0.000190586 | 0.001312022 | 0.591296967 | 0.619571796 |
| 82 | C | −4.921711384 | 0.000354375 | 0.002068057 | −0.047884458 | 0.619705659 |
| 83 | C | −5.958715792 | 0.0000667 | 0.000622892 | 1.676326053 | 0.62225809 |
| 84 | C | −5.375009075 | 0.000167583 | 0.001195029 | 0.724015211 | 0.622611531 |
| 85 | C | −2.836188313 | 0.015022234 | 0.035904842 | −3.838744638 | 0.622621343 |
| 86 | C | −8.972838358 | 0.00000115 | 0.0000437 | 5.859426477 | 0.622640998 |
| 87 | C | −6.377946527 | 0.0000354 | 0.000401584 | 2.330609292 | 0.62435051 |
| 88 | C | −5.932985254 | 0.0000694 | 0.000640919 | 1.635358941 | 0.627095758 |
| 89 | C | −12.67563219 | 0.0000000266 | 0.00000483 | 9.661689053 | 0.629153324 |
| 90 | C | −8.071203637 | 0.00000347 | 0.0000870 | 4.728897646 | 0.631350526 |
| 91 | C | −8.777886199 | 0.00000145 | 0.0000506 | 5.622886101 | 0.631728314 |
| 92 | C | −10.4590631 | 0.000000223 | 0.0000160 | 7.532411369 | 0.632344784 |
| 93 | C | −5.839220812 | 0.0000802 | 0.000708795 | 1.48527768 | 0.632757597 |
| 94 | C | −14.07522205 | 0.00000000818 | 0.00000260 | 10.82253301 | 0.633661247 |
| 95 | C | −6.411983432 | 0.0000337 | 0.000388614 | 2.382641664 | 0.634293359 |
| 96 | C | −5.445245296 | 0.000149608 | 0.001102029 | 0.841128152 | 0.635804281 |
| 97 | C | −10.42177056 | 0.000000232 | 0.0000163 | 7.49306565 | 0.636269107 |
| 98 | C | −2.323991609 | 0.03851793 | 0.076770932 | −4.74879567 | 0.637180615 |

TABLE 8.2c-continued

| No. | Group | t | P.Value | adj.P.Val | B | FC |
|---|---|---|---|---|---|---|
| 99 | C | −5.380251013 | 0.000166166 | 0.001187454 | 0.732779215 | 0.637446608 |
| 100 | C | −5.867036849 | 0.0000768 | 0.000687439 | 1.529930436 | 0.6378717 |
| 101 | C | −11.93737725 | 0.0000000521 | 0.00000676 | 8.995489036 | 0.639805863 |
| 102 | C | −12.94887187 | 0.0000000210 | 0.00000422 | 9.898415521 | 0.641509918 |

TABLE 8.2d

| No. | Group | FC_1 | LS | Loop Detected |
|---|---|---|---|---|
| 52 | B | −1.502014063 | −1 | Severe Autism |
| 53 | B | −1.501940657 | −1 | Severe Autism |
| 54 | B | −1.50113227 | −1 | Severe Autism |
| 55 | B | −1.499963371 | −1 | Severe Autism |
| 56 | B | −1.499710899 | −1 | Severe Autism |
| 57 | B | −1.49890481 | −1 | Severe Autism |
| 58 | B | −1.497333553 | −1 | Severe Autism |
| 59 | B | −1.496057102 | −1 | Severe Autism |
| 60 | B | −1.49579831 | −1 | Severe Autism |
| 61 | B | −1.495118578 | −1 | Severe Autism |
| 62 | B | −1.493859575 | −1 | Severe Autism |
| 63 | B | −1.492940924 | −1 | Severe Autism |
| 64 | B | −1.491890087 | −1 | Severe Autism |
| 65 | B | −1.490244608 | −1 | Severe Autism |
| 66 | B | −1.489086493 | −1 | Severe Autism |
| 67 | B | −1.487496435 | −1 | Severe Autism |
| 68 | B | −1.486763521 | −1 | Severe Autism |
| 69 | B | −1.48535255 | −1 | Severe Autism |
| 70 | B | −1.483872733 | −1 | Severe Autism |
| 71 | B | −1.482136321 | −1 | Severe Autism |
| 72 | B | −1.481629723 | −1 | Severe Autism |
| 73 | B | −1.481559144 | −1 | Severe Autism |
| 74 | B | −1.480869934 | −1 | Severe Autism |
| 75 | B | −1.479772552 | −1 | Severe Autism |
| 76 | B | −1.47901319 | −1 | Severe Autism |
| 77 | C | −1.627624519 | −1 | Severe Autism |

TABLE 8.2d-continued

| No. | Group | FC_1 | LS | Loop Detected |
|---|---|---|---|---|
| 78 | C | −1.623339524 | −1 | Severe Autism |
| 79 | C | −1.621027449 | −1 | Severe Autism |
| 80 | C | −1.620578627 | −1 | Severe Autism |
| 81 | C | −1.614017949 | −1 | Severe Autism |
| 82 | C | −1.613669305 | −1 | Severe Autism |
| 83 | C | −1.60705022 | −1 | Severe Autism |
| 84 | C | −1.606137937 | −1 | Severe Autism |
| 85 | C | −1.606112625 | −1 | Severe Autism |
| 86 | C | −1.606061925 | −1 | Severe Autism |
| 87 | C | −1.601664423 | −1 | Severe Autism |
| 88 | C | −1.59465279 | −1 | Severe Autism |
| 89 | C | −1.58943768 | −1 | Severe Autism |
| 90 | C | −1.58390618 | −1 | Severe Autism |
| 91 | C | −1.582958968 | −1 | Severe Autism |
| 92 | C | −1.581415748 | −1 | Severe Autism |
| 93 | C | −1.580384029 | −1 | Severe Autism |
| 94 | C | −1.578130278 | −1 | Severe Autism |
| 95 | C | −1.576557576 | −1 | Severe Autism |
| 96 | C | −1.572811051 | −1 | Severe Autism |
| 97 | C | −1.571662035 | −1 | Severe Autism |
| 98 | C | −1.569413721 | −1 | Severe Autism |
| 99 | C | −1.568758837 | −1 | Severe Autism |
| 100 | C | −1.567713383 | −1 | Severe Autism |
| 101 | C | −1.562974111 | −1 | Severe Autism |
| 102 | C | −1.558822352 | −1 | Severe Autism |

TABLE 8.2e

| No. | Group | Probe sequence 60 mer | Probe Location Chr |
|---|---|---|---|
| 52 | B | GAAGTTTCAACTTGATTCTTTCTAACTTTCGATTTTTTAAAAATTGTCATTCTGACTGGA (SEQ ID NO: 3755) | 11 |
| 53 | B | AACCCCTCTGAGCAAATCTCCCACTGCCTCGAGGTTAATTTTTTCCCCTCTTAATAAGCG (SEQ ID NO: 3639) | 5 |
| 54 | B | ATTTAATTCACACAGTAGGATTATAAGGTCGACCGAAATGTGTATTCCTCTTGTGAAGGA (SEQ ID NO: 3757) | 14 |
| 55 | B | TCCTTCCACTTTCAGTTCCCCATACACATCGAAAAAAATATCAAGGTGAAAATTCAAGTT (SEQ ID NO: 3758) | 1 |
| 56 | B | CATCTCTTTACTATTAATTCTTTCCTGTTCGATCACTCTATCTATCTATCATCTCTCACC (SEQ ID NO: 3759) | 18 |
| 57 | B | CTGACACTTGAACCATAATTTTTTTCATTCGAAAGGGATATAAAAAATTCCAAGTATTAA (SEQ ID NO: 3760) | 18 |
| 58 | B | CCTGGGTGGAATTCACCCAGGAATACAATCGATTTCCTCATCTATAAAAATGAAGCTGAC (SEQ ID NO: 3761) | 15 |
| 59 | B | TACAACACATAAACATTAGCAAGTTGAATCGACTTTGCTCTCAGGTAGTCCCATTATGTG (SEQ ID NO: 3762) | 1 |
| 60 | B | CAACATCCATGGAAGTTGCTCGAAGAATCGAAAAAAAAATAAAAAAATAAAAAAATAAA (SEQ ID NO: 3763) | 2 |
| 61 | B | TGAAGCTTTAGTTTAGCGACTAAAGTCATCGATTTTTTTCACATCAACGTTACACCAAAA (SEQ ID NO: 3764) | 6 |
| 62 | B | CCCCACTCTGCCCTCAATTGTGGTTCATTCGAATCTCTCTAGTAATAAAAACATCACTGT (SEQ ID NO: 3765) | 9 |

TABLE 8.2e-continued

| No. | Group | Probe sequence 60 mer | Probe Location Chr |
|---|---|---|---|
| 63 | B | TCTGCATAAATGACTCAATACAAGTTTTTCGAATGACATTCATATGGGCAAAAATTATGC (SEQ ID NO: 3766) | 1 |
| 64 | B | TGAAAACAAAGTTGATATCTCACTCACTTCGAGGTGTGAGAGGGATTTGCTATTACTGTC (SEQ ID NO: 3767) | 16 |
| 65 | B | CTACTGAGTCATATTATTCGCCTTTTTTTCGAATATTGCCTTCTCCTCAACCACCACTGG (SEQ ID NO: 3768) | 3 |
| 66 | B | GCTTGATCTTTCCACATCCTCTATCTTTTCGAAATGTATCCACCCACCCCACCTCTAAAC (SEQ ID NO: 3769) | 1 |
| 67 | B | GCATTTTTATGAAATTAAATGTCCGTATTCGATTCTCAACCTCTTGCTTAGGTACACACA (SEQ ID NO: 2592) | 3 |
| 68 | B | TAAACTTTTAAAGAAAGCAAGAATTGCATCGAAGGCTTCTGTAAGCATATATGTAAAGCT (SEQ ID NO: 3771) | 6 |
| 69 | B | TTAATCTGTGTCAGGAAATTTCATAATTTCGAAGATAAGGCATATGGGAGATGCATCTCT (SEQ ID NO: 3772) | 2 |
| 70 | B | ACAAAAATTAACTCAAAATTGATCATCATCGATGATACTTAACAACATTTCAAACCAGGC (SEQ ID NO: 3773) | 16 |
| 71 | B | CTGGATCTGTTATTTATCTAATTATACCTCGATTTCACCAAGTTTGCAAAAGATTCTGTG (SEQ ID NO: 3774) | 2 |
| 72 | B | ACATAGTGGGCCTTCAATGAGTGTGTATTCGAATTCCTGCCCGCCCCCACACCTTCCAGC (SEQ ID NO: 3775) | 12 |
| 73 | B | TTTTGTAACAGAATTTCTCTTGATCTCCTCGAAGATCAGGTGCTGTATCTTTTATATCTT (SEQ ID NO: 3776) | 4 |
| 74 | B | TTAATCTACTCTCTATCTGTGTAGATTCTCGAGAACTAGCCAGTAACAAAAGCTGTGATT (SEQ ID NO: 3777) | 22 |
| 75 | B | AGATAATTTAGGGATCTATTTGCTTTTTTCGATAACCTCCTGACCTTGTCTTTCCTATAA (SEQ ID NO: 3778) | 8 |
| 76 | B | TATATACCTCAGCAAAAAAAAATTAAATCGATTTGTAGATACAGGCAATGCCATGGAGA (SEQ ID NO: 3779) | 6 |
| 77 | C | CCATCCCCACCTCTTTCCTACCTGCCCTTCGATGCTTCCAGTGATTAGACCCCGGGTCCG (SEQ ID NO: 3780) | 12 |
| 78 | C | AAACTTTAAAACAAAATGAAGTTCTAATTCGACACTATTGAATATATCATAGCAGTTAGA (SEQ ID NO: 3781) | 4 |
| 79 | C | CCCTGTCTCTAAAAAATAATAATAATAATCGAGATGATGGAAGTAAGAATAGTGGTTATT (SEQ ID NO: 3782) | 19 |
| 80 | C | AGATTAAAAGTATGAGCAGAGATAAGACTCGAACCATTTTGCTACCAATAAACTGCTTTA (SEQ ID NO: 3783) | 8 |
| 81 | C | TTTTAGACACAAAAAATTACAGGTACATTCGATTGTGTAAACAGGGATAATTATAATATT (SEQ ID NO: 3784) | 2 |
| 82 | C | TGTCCCTCTTCCTCATTTATCTACTTAGTCGATATGTATGTAATCAATCCATTCAATATC (SEQ ID NO: 3785) | 6 |
| 83 | C | TGAGATAATAGAATAGAACATTTTCATATCGATCCAGAGGAAAAAAACTAATAGTGGCAA (SEQ ID NO: 3786) | 12 |
| 84 | C | TTTTTAATCTTATAATCACGTTACCCATTCGAAATGTACACTTAAAAGGGTGAATTAGG (SEQ ID NO: 3787) | 5 |
| 85 | C | CTCTTTCAAAACCCTTGCGAGGATTGGTTCGAATGTGATATTTCTGGTTCTTGGTATAAT (SEQ ID NO: 3788) | 2 |
| 86 | C | GGGTTTGTTGTCAAATGTTAATCGTAATTCGAAGATGAAGAAAACACAGCTTCTTCCCTC (SEQ ID NO: 3789) | 5 |
| 87 | C | TTGTCTAATAAACGTCATAAAGAGATAATCGAAAATTTGAAATAATTACTAAGAACGGTT (SEQ ID NO: 3790) | 2 |
| 88 | C | TCTAACCATTATGAGTAGATATTAATCTTCGAGGCTTATTTAAAGACTGCCTCTTTCACA (SEQ ID NO: 3791) | 14 |

TABLE 8.2e-continued

| No. | Group | Probe sequence 60 mer | Probe Location Chr |
|---|---|---|---|
| 89 | C | CCCGATTACTTCAGATTTACTTACAGCCTCGAAGAAAAGGTATGGAAAACTTCAAAATTT (SEQ ID NO: 3792) | 2 |
| 90 | C | AGTTAATGGTATTAAGGATTTCAGTTCATCGAGTTTCAGTGCATTTTTTACTTACTTTGA (SEQ ID NO: 3793) | 4 |
| 91 | C | CATGCAAATGCTGAAGAATACCTAGTTTTCGATTTAATAGTTTAGCATCAGAAGCAGACC (SEQ ID NO: 3794) | 7 |
| 92 | C | AACCCCTCTGAGCAAATCTCCCACTGCCTCGACTTAACTGGAGGCTTGGTCCTTTCCGAG (SEQ ID NO: 3623) | 5 |
| 93 | C | TTAAAATATTCTGGAAGACAATTATCTATCGAAGAAATAAAAACATCAATCAAGGACTGG (SEQ ID NO: 3796) | 12 |
| 94 | C | AACCCCTCTGAGCAAATCTCCCACTGCCTCGATTTCCTCGCCTGTGAAATGGGAAATCAG (SEQ ID NO: 3643) | 5 |
| 95 | C | AATATAAACAAAAGCTTTGTAATTACTATCGATCTTGTAGGAGGAAGGACGAGATGTGTG (SEQ ID NO: 3798) | 2 |
| 96 | C | AAGGTTGTTGAATGAATAAAAGAGGTACTCGATAAGGAAACAGTAGAGAGATTAATTATC (SEQ ID NO: 3799) | 12 |
| 97 | C | AGAAAATATAGCAAATATCTTTATGACCTCGACTCCCCTAGAGGAAATATATTTTATTTC (SEQ ID NO: 3800) | 10 |
| 98 | C | ATATAATGTCAGCATTTCAAAACAGCACTCGATGGAAAACAATGCCACAGGCAAAGAACC (SEQ ID NO: 3801) | 5 |
| 99 | C | TGGCTCATTCATTTACTTATTTATTCATTCGATATTCTCTCCAGATTGTGCATCAAGGTT (SEQ ID NO: 3802) | 14 |
| 100 | C | TGCAGATGATAATAATAACTACCATTTATCGAGAATGTTCTGCATGGAAAAGACAGAGAA (SEQ ID NO: 3803) | 15 |
| 101 | C | AACCCCTCTGAGCAAATCTCCCACTGCCTCGACTTCCCGGAAATTCTGACCTGTAGCATT (SEQ ID NO: 3624) | 5 |
| 102 | C | AACCCCTCTGAGCAAATCTCCCACTGCCTCGAACCTCATGTTTAGGTGGTGGAAGCGAGT (SEQ ID NO: 3633) | 5 |

TABLE 8.2f

| No. | Group | Probe Location | | | | 4 kb Sequence Location | |
|---|---|---|---|---|---|---|---|
| | | Start1 | End1 | Start2 | End2 | Chr | Start1 |
| 52 | B | 87934295 | 87934324 | 88006233 | 88006262 | 11 | 87930325 |
| 53 | B | 14296088 | 14296117 | 14319860 | 14319889 | 5 | 14296088 |
| 54 | B | 85582586 | 85582615 | 85612894 | 85612923 | 14 | 85582586 |
| 55 | B | 177061514 | 177061543 | 177184008 | 177184037 | 1 | 177061514 |
| 56 | B | 10268752 | 10268781 | 10331129 | 10331158 | 18 | 10264782 |
| 57 | B | 28088401 | 28088430 | 28142422 | 28142451 | 18 | 28084431 |
| 58 | B | 89408825 | 89408854 | 89472349 | 89472378 | 15 | 89404855 |
| 59 | B | 246640284 | 246640313 | 246665001 | 246665030 | 1 | 246640284 |
| 60 | B | 66475623 | 66475652 | 66592402 | 66592431 | 2 | 66471653 |
| 61 | B | 168253926 | 168253955 | 168300512 | 168300541 | 6 | 168253926 |
| 62 | B | 8143192 | 8143221 | 8167173 | 8167202 | 9 | 8139222 |
| 63 | B | 116582108 | 116582137 | 116593952 | 116593981 | 1 | 116578138 |
| 64 | B | 75913435 | 75913464 | 75948235 | 75948264 | 16 | 75909465 |
| 65 | B | 116555346 | 116555375 | 116607022 | 116607051 | 3 | 116555346 |
| 66 | B | 111535222 | 111535251 | 111572627 | 111572656 | 1 | 111535222 |
| 67 | B | 64195292 | 64195321 | 64266978 | 64267007 | 3 | 64191322 |
| 68 | B | 139965929 | 139965958 | 140011997 | 140012026 | 6 | 139965929 |
| 69 | B | 197111953 | 197111982 | 197161231 | 197161260 | 2 | 197111953 |
| 70 | B | 51538980 | 51539009 | 51564534 | 51564563 | 16 | 51538980 |
| 71 | B | 102944310 | 102944339 | 102983002 | 102983031 | 2 | 102940340 |
| 72 | B | 134196 | 134225 | 79806 | 79835 | 12 | 134196 |
| 73 | B | 109570281 | 109570310 | 109611915 | 109611944 | 4 | 109570281 |
| 74 | B | 26723698 | 26723727 | 26757531 | 26757560 | 22 | 26723698 |
| 75 | B | 29048918 | 29048947 | 29063472 | 29063501 | 8 | 29044948 |
| 76 | B | 114223084 | 114223113 | 114291530 | 114291559 | 6 | 114223084 |

TABLE 8.2f-continued

| | | Probe Location | | | | 4 kb Sequence Location | |
| --- | --- | --- | --- | --- | --- | --- | --- |
| No. | Group | Start1 | End1 | Start2 | End2 | Chr | Start1 |
| 77 | C | 81301128 | 81301157 | 81329844 | 81329873 | 12 | 81301128 |
| 78 | C | 152172707 | 152172736 | 152227665 | 152227694 | 4 | 152168737 |
| 79 | C | 52224154 | 52224183 | 52267683 | 52267712 | 19 | 52224154 |
| 80 | C | 86595633 | 86595662 | 86648388 | 86648417 | 8 | 86595633 |
| 81 | C | 120644246 | 120644275 | 120661475 | 120661504 | 2 | 120640276 |
| 82 | C | 27443473 | 27443502 | 27477909 | 27477938 | 6 | 27443473 |
| 83 | C | 13672706 | 13672735 | 13723882 | 13723911 | 12 | 13672706 |
| 84 | C | 149610434 | 149610463 | 149663577 | 149663606 | 5 | 149610434 |
| 85 | C | 98177773 | 98177802 | 98209754 | 98209783 | 2 | 98173803 |
| 86 | C | 136172589 | 136172618 | 136237370 | 136237399 | 5 | 136168619 |
| 87 | C | 198099688 | 198099717 | 198137326 | 198137355 | 2 | 198099688 |
| 88 | C | 68293668 | 68293697 | 68327682 | 68327711 | 14 | 68293668 |
| 89 | C | 209644806 | 209644835 | 209692609 | 209692638 | 2 | 209644806 |
| 90 | C | 152757076 | 152757105 | 152787174 | 152787203 | 4 | 152757076 |
| 91 | C | 8358876 | 8358905 | 8389866 | 8389895 | 7 | 8358876 |
| 92 | C | 14296088 | 14296117 | 14351874 | 14351903 | 5 | 14296088 |
| 93 | C | 130252465 | 130252494 | 130276555 | 130276584 | 12 | 130248495 |
| 94 | C | 14296088 | 14296117 | 14334111 | 14334140 | 5 | 14296088 |
| 95 | C | 2296448 | 2296477 | 2317982 | 2318011 | 2 | 2292478 |
| 96 | C | 130189603 | 130189632 | 130248320 | 130248349 | 12 | 130189603 |
| 97 | C | 85560666 | 85560695 | 85593193 | 85593222 | 10 | 85560666 |
| 98 | C | 107295109 | 107295138 | 107377017 | 107377046 | 5 | 107295109 |
| 99 | C | 29277226 | 29277255 | 29341728 | 29341757 | 14 | 29277226 |
| 100 | C | 68642933 | 68642962 | 68679528 | 68679557 | 15 | 68642933 |
| 101 | C | 14296088 | 14296117 | 14364875 | 14364904 | 5 | 14296088 |
| 102 | C | 14296088 | 14296117 | 14331607 | 14331636 | 5 | 14296088 |

TABLE 8.2g

| | C | 4 kb Sequence Location | | | |
| --- | --- | --- | --- | --- | --- |
| No. | Group | End1 | Start2 | End2 | Probe |
| 52 | B | 87934324 | 88002263 | 88006262 | ORF13_11_87926403_87934326_87969207_88006264_FF |
| 53 | B | 14300087 | 14319860 | 14323859 | ORF107_5_14296086_14298950_14319858_14323303_RR |
| 54 | B | 85586585 | 85612894 | 85616893 | ORF122_14_85582584_85584999_85612892_85619304_RR |
| 55 | B | 177065513 | 177180038 | 177184037 | ORF18_1_177061512_177062775_177182650_177184039_RF |
| 56 | B | 10268781 | 10331129 | 10335128 | ORF10_18_10266375_10268783_10331127_10332730_FR |
| 57 | B | 28088430 | 28142422 | 28146421 | ORF175_18_28083723_28088432_28142420_28147707_FR |
| 58 | B | 89408854 | 89468379 | 89472378 | ORF186_15_89407225_89408856_89469667_89472380_FF |
| 59 | B | 246644283 | 246665001 | 246669000 | ORF18_1_246640282_246644196_246664999_246668825_RR |
| 60 | B | 66475652 | 66592402 | 66596401 | ORF10_2_66470757_66475654_66592400_66595314_FR |
| 61 | B | 168257925 | 168296542 | 168300541 | ORF13_6_168253924_168260800_168295264_168300543_RF |
| 62 | B | 8143221 | 8167173 | 8171172 | ORF171_9_8138555_8143223_8167171_8181381_FR |
| 63 | B | 116582137 | 116593952 | 116597951 | ORF153_1_116579148_116582139_116593950_116598324_FR |
| 64 | B | 75913464 | 75948235 | 75952234 | ORF11_16_75911508_75913466_75948233_75952817_FR |
| 65 | B | 116559345 | 116607022 | 116611021 | ORF112_3_116555344_116556412_116607020_116611600_RR |
| 66 | B | 111539221 | 111568657 | 111572656 | ORF150_1_111535220_111538688_111567009_111572658_RF |
| 67 | B | 64195321 | 64266978 | 64270977 | ORF148_3_64194265_64195323_64266976_64268244_FR |
| 68 | B | 139969928 | 140008027 | 140012026 | ORF185_6_139965927_139972052_140005899_140012028_RF |
| 69 | B | 197115952 | 197161231 | 197165230 | ORF172_2_197111951_197117459_197161229_197162625_RR |
| 70 | B | 51542979 | 51560564 | 51564563 | ORF16_16_51538978_51545978_51556847_51564565_RF |
| 71 | B | 102944339 | 102983002 | 102987001 | ORF100_2_102942687_102944341_102983000_102995309_FR |
| 72 | B | 138195 | 79806 | 83805 | ORF16_12_134194_137994_79804_82702_RR |
| 73 | B | 109574280 | 109607945 | 109611944 | ORF133_4_109570279_109575929_109606195_109611946_RF |
| 74 | B | 26727697 | 26753561 | 26757560 | ORF123_22_26723696_26756491_26757562_RF |
| 75 | B | 29048947 | 29063472 | 29067471 | ORF157_8_29047786_29048949_29063470_29065562_FR |
| 76 | B | 114227083 | 114291530 | 114295529 | ORF185_6_114223082_114225950_114291528_114299574_RR |
| 77 | C | 81305127 | 81329844 | 81333843 | ORF138_12_81301126_81306761_81329842_81332845_RR |
| 78 | C | 152172736 | 152223695 | 152227694 | ORF125_4_152168385_152172738_152221305_152227696_FF |
| 79 | C | 52228153 | 52263713 | 52267712 | ORF185_19_52224152_52228867_52265664_52267714_RF |
| 80 | C | 86599632 | 86648388 | 86652387 | ORF173_8_86595631_86604532_86648386_86651477_RR |
| 81 | C | 120644275 | 120657505 | 120661504 | ORF10_2_120634320_120644277_120657582_120661506_FF |
| 82 | C | 27447472 | 27473939 | 27477938 | ORF100_6_27443471_27448356_27474091_27477940_RF |
| 83 | C | 13676705 | 13723882 | 13727881 | ORF17_12_13672704_13680228_13723880_13729648_RR |
| 84 | C | 149614433 | 149663577 | 149667576 | ORF18_5_149610432_149612632_149663575_149665859_RR |
| 85 | C | 98177802 | 98209754 | 98213753 | ORF136_2_98173571_98177804_98209752_98213279_FR |
| 86 | C | 136172618 | 136233400 | 136237399 | ORF151_5_136165905_136172620_136234001_136237401_FF |
| 87 | C | 198103687 | 198137326 | 198141325 | ORF182_2_198099686_198102962_198137324_198146976_RR |
| 88 | C | 68297667 | 68323712 | 68327711 | ORF171_14_68293666_68299109_68325745_68327713_RF |
| 89 | C | 209648805 | 209688639 | 209692638 | ORF108_2_209644804_209647666_209684451_209692640_RF |
| 90 | C | 152761075 | 152783204 | 152787203 | ORF160_4_152757074_152760709_152780762_152787205_RF |
| 91 | C | 8362875 | 8389866 | 8393865 | ORF127_7_8358874_8360456_8389864_8393728_RR |

TABLE 8.2g-continued

|  |  | C | 4 kb Sequence Location |  |  |
|---|---|---|---|---|---|
| No. | Group | End1 | Start2 | End2 | Probe |
| 92 | C | 14300087 | 14351874 | 14355873 | ORF145_5_14296086_14298950_14351872_14353515_RR |
| 93 | C | 130252494 | 130272585 | 130276584 | ORF124_12_130248318_130252496_130274212_130276586_FF |
| 94 | C | 14300087 | 14334111 | 14338110 | ORF114_5_14296086_14298950_14334109_14335762_RR |
| 95 | C | 2296477 | 2317982 | 2321981 | ORF134_2_2294551_2296479_2317980_2323920_FR |
| 96 | C | 130193602 | 130248320 | 130252319 | ORF198_12_130189601_130192155_130248318_130252496_RR |
| 97 | C | 85564665 | 85593193 | 85597192 | ORF164_10_85560664_85563397_85593191_85595358_RR |
| 98 | C | 107299108 | 107373047 | 107377046 | ORF132_5_107295107_107306594_107372426_107377048_RF |
| 99 | C | 29281225 | 29337758 | 29341757 | ORF135_14_29277224_29280917_29340222_29341759_RF |
| 100 | C | 68646932 | 68675558 | 68679557 | ORF118_15_68642931_68645237_68673635_68679559_RF |
| 101 | C | 14300087 | 14364875 | 14368874 | ORF123_5_14296086_14298950_14364873_14369388_RR |
| 102 | C | 14300087 | 14331607 | 14335606 | ORF103_5_14296086_14298950_14331605_14334109_RR |

TABLE 8.2h

| No. | Group | PCR-Primer1_ID | PCR_Primer1 | PCR-Primer2_ID | PCR_Primer2 |
|---|---|---|---|---|---|
| 52 | B | OBD159_3805 | GCCAATAACCTTCCAGCATCTCCCTGAA (SEQ ID NO: 3806) | OBD159_3807 | CCTCTTATCAGATGTATAGTT (SEQ ID NO: 3820) |
| 53 | B | OBD159_3809 | GTGCGGGATTCAGACCTTCAGCA (SEQ ID NO: 3674) | OBD159_3811 | CGCCACGCCTGACTACCATCCAA (SEQ ID NO: 3741) |
| 54 | B | OBD159_3813 | CCAGGCACCTTATTTGAGATGTCTTC (SEQ ID NO: 3808) | OBD159_3815 | GCATACTACTTTACCATTCCACACAG (SEQ ID NO: 3822) |
| 55 | B | OBD159_3817 | CCCTGGTCATTCTTCCTGTTGGAGAC (SEQ ID NO: 3809) | OBD159_3819 | TCGGGAGGTATCAGGTATTCAAACTG (SEQ ID NO: 3823) |
| 56 | B | OBD159_3821 | GAGCCTCACCAATCCCACTCCCTTCTGG (SEQ ID NO: 3810) | OBD159_3823 | GGTGATTCCGATGTGGTCCCAGCCCTG (SEQ ID NO: 3824) |
| 57 | B | OBD159_3825 | CGTAAGCCCTGAACACGCAAATGAGT (SEQ ID NO: 3811) | OBD159_3827 | AGTGGTTCCAAGACAGAGATTGTTCT (SEQ ID NO: 3825) |
| 58 | B | OBD159_3829 | GGAAAAGTGGCTCCTCTGGGAACCCG (SEQ ID NO: 3812) | OBD159_3831 | GACCAGCAAGGACCCCAGTTTCTCCAC (SEQ ID NO: 3826) |
| 59 | B | OBD159_3833 | CTATTGTCTCCCTTTGTCTTCAGAAATC (SEQ ID NO: 3813) | OBD159_3835 | CCACCCCGACAGCATTATTTGACAGTCT (SEQ ID NO: 3827) |
| 60 | B | OBD159_3837 | CCCTGAGCTTCCTAGCAGCTAAAACAAAG (SEQ ID NO: 3814) | OBD159_3839 | TATATTGTTATTGTAATTGCCATTAAATGGT (SEQ ID NO: 3828) |
| 61 | B | OBD159_3841 | GGGTGGCGATGGAGGAGAGTCAT (SEQ ID NO: 3815) | OBD159_3843 | GCAGCAGGTCCTCAGATGATGTC (SEQ ID NO: 1496) |
| 62 | B | OBD159_3845 | TTTACAGCCCCACCAGCAACACAGGA (SEQ ID NO: 3816) | OBD159_3847 | GGGCTGGTATTTTCTTTATCTGGTGG (SEQ ID NO: 3830) |
| 63 | B | OBD159_3849 | CACCTCCTCCCTCTTCAATCTCC (SEQ ID NO: 3817) | OBD159_3851 | GGAGGCACAGTCACAGTCAACGC (SEQ ID NO: 3831) |
| 64 | B | OBD159_3853 | CGTCTTTCTCCCATACCTTCAAGTCT (SEQ ID NO: 3818) | OBD159_3855 | CTGGTCTACCCCTTCCTCCATCTCTA (SEQ ID NO: 3832) |
| 65 | B | OBD159_3857 | CTCACGACAATCATCTCTCAAAAGGC (SEQ ID NO: 3819) | OBD159_3859 | GCTGCTGCTTCTCTCCAATGTCTA (SEQ ID NO: 3833) |
| 66 | B | OBD159_3861 | CACCACCCCATCAATCTGCTCTG (SEQ ID NO: 3834) | OBD159_3863 | GACTGCTGGGTCCTTTTGCCGTG (SEQ ID NO: 3871) |
| 67 | B | OBD159_3865 | GCCTTTCCTTTCTGGCATCATCTGTT (SEQ ID NO: 2698) | OBD159_3867 | GGAAAGATTGTGGGTAGGTGCTGGGT (SEQ ID NO: 2804) |
| 68 | B | OBD159_3869 | CAGATTGTGAGGCACCCTTGGATCTTGACCT (SEQ ID NO: 3836) | OBD159_3871 | TAGAAACATAAAATATCCTTT (SEQ ID NO: 3873) |

TABLE 8.2h-continued

| No. | Group | Primer1_ID | PCR_Primer1 | PCR-Primer2_ID | PCR_Primer2 |
|---|---|---|---|---|---|
| 69 | B | OBD159_3873 | GATGAAAATACATTCTCTCTATTGGG (SEQ ID NO: 3837) | OBD159_3875 | CACATGGGCTAAGAGGCCCTAGAA (SEQ ID NO: 3874) |
| 70 | B | OBD159_3877 | CCACACAAATAGACTTGACTGAGTTT (SEQ ID NO: 3838) | OBD159_3879 | GGCTATGGGAGGGAGAGGAAGAAATA (SEQ ID NO: 3875) |
| 71 | B | OBD159_3881 | CATCTCAGGAAATGAAATAGCCCTCAGC (SEQ ID NO: 3839) | OBD159_3883 | CTATGGACTGCTTGGGCTTCCTGACAGC (SEQ ID NO: 3876) |
| 72 | B | OBD159_3885 | CCCACGAGGGCAGATTTCACCTG (SEQ ID NO: 3840) | OBD159_3887 | CTCAGCAGACAGCAGAAAGGACC (SEQ ID NO: 3877) |
| 73 | B | OBD159_3889 | GTGAAAATGAAGCAGATGGCAAACTGGG (SEQ ID NO: 3841) | OBD159_3891 | GTTTACCAATCTCTGACATAGACCAACA (SEQ ID NO: 3878) |
| 74 | B | OBD159_3893 | GCAATCCCTCCAGCCCTTGTCAA (SEQ ID NO: 3842) | OBD159_3895 | TGTTGTCCTCCCAGCCTCCAGAG (SEQ ID NO: 3879) |
| 75 | B | OBD159_3897 | AAATGTGTGCCTCCCCTGACCTACA (SEQ ID NO: 3843) | OBD159_3899 | ATACGAGTGGCAGGTTAGTTCATTAT (SEQ ID NO: 3880) |
| 76 | B | OBD159_3901 | GTAACACATTCTTCAAACATAGTCCC (SEQ ID NO: 3844) | OBD159_3903 | AGAAATCACTCTCTGCCATCTCC (SEQ ID NO: 3881) |
| 77 | C | OBD159_3325 | CTCCCCATTAGTGCTTCTCCTGC (SEQ ID NO: 3845) | OBD159_3327 | GGAAAGTTCAGGGCTGGCAGTGC (SEQ ID NO: 3882) |
| 78 | C | OBD159_3269 | GCCTCCACTGATGTTAGCCTGTGACA (SEQ ID NO: 3846) | OBD159_3271 | GGTTCTTTCTTGTTTTGCTCACCACC (SEQ ID NO: 3883) |
| 79 | C | OBD159_3177 | AGTGGCTGAGGCAAGAGGATGTC (SEQ ID NO: 3847) | OBD159_3179 | GCTGAGGTTGTGTCCTGGAACAGAC (SEQ ID NO: 3884) |
| 80 | C | OBD159_3201 | CCCCTATTACATTAGTCAAATCACCT (SEQ ID NO: 3848) | OBD159_3203 | TTTCTTTGCTCTCCTCTCTCAGCCTG (SEQ ID NO: 3885) |
| 81 | C | OBD159_3357 | GCCATTTCTCACCCGCTCAGTAG (SEQ ID NO: 3849) | OBD159_3359 | GACTGCTGGGCTGGAAAATCCCC (SEQ ID NO: 3886) |
| 82 | C | OBD159_3637 | CCTCCTGTCCCTCCTTCCTTTCTC (SEQ ID NO: 3850) | OBD159_3639 | GGTGTGGATGTCTGAGGTGGAAG (SEQ ID NO: 3887) |
| 83 | C | OBD159_3369 | TATGTTGTTGCCCTTGATACGGTAGC (SEQ ID NO: 590) | OBD159_3371 | GGGTCTCCAGGTCCCATTCTTTTCCT (SEQ ID NO: 3888) |
| 84 | C | OBD159_3485 | CGCCTGTTGTCCCAGCACTGTAGATA (SEQ ID NO: 3852) | OBD159_3487 | GGTATCAGGCTATTTCCTTCTGCTAC (SEQ ID NO: 3889) |
| 85 | C | OBD159_3449 | CGCCTGGTCCACTGTGAAGTTGG (SEQ ID NO: 3853) | OBD159_3451 | TACACCCAAACACAGCGACTGCG (SEQ ID NO: 3890) |
| 86 | C | OBD159_3337 | GCCTATGAAGAGCCTAAACATTGGTG (SEQ ID NO: 3854) | OBD159_3339 | CCACAGAACTGATGCCAAGAACTGGG (SEQ ID NO: 3891) |
| 87 | C | OBD159_3197 | TAGTTCAAGTTCTTCTCAAAAGCCCC (SEQ ID NO: 626) | OBD159_3199 | GTTACCGCCTTTATGGCACAGCACCA (SEQ ID NO: 3892) |
| 88 | C | OBD159_3265 | ACAAGGAGCCAAAGGTAAACAGACTG (SEQ ID NO: 3856) | OBD159_3267 | GAGACCATAGGCAAGCAGGTTCTGTG (SEQ ID NO: 3893) |
| 89 | C | OBD159_3185 | GCTTATTTCCTGAACGCACTTGCCTA (SEQ ID NO: 2412) | OBD159_3187 | GGATAACTCCAGGACTAAGGATGC (SEQ ID NO: 3894) |
| 90 | C | OBD159_3241 | AGCATCATACATTTCCCGCAGTTTGC (SEQ ID NO: 3858) | OBD159_3243 | TGAGACCGATAAAGGTAGAGGGTTTT (SEQ ID NO: 3895) |
| 91 | C | OBD159_3365 | TTGTGCTACATTTTCCTCCCTAAGAG (SEQ ID NO: 3859) | OBD159_3367 | CCCTCGGTTCCCTCACTCTTTTCTGT (SEQ ID NO: 3896) |
| 92 | C | OBD159_3309 | GTGCGGGATTCAGACCTTCAGCA (SEQ ID NO: 3674) | OBD159_3311 | ACTACCTGGAAAGGGAGACCCCG (SEQ ID NO: 3725) |

TABLE 8.2h-continued

| No. | Group | Primer1_ID | PCR_Primer1 | PCR-Primer2_ID | PCR_Primer2 |
|---|---|---|---|---|---|
| 93 | C | OBD159_3389 | GCTGCTGGGAGGGTCTTACACTG (SEQ ID NO: 3861) | OBD159_3391 | CAGGGCTTGCTTTGGACAGGAGT (SEQ ID NO: 3898) |
| 94 | C | OBD159_3233 | GGTGCGGGATTCAGACCTTCAGC (SEQ ID NO: 3675) | OBD159_3235 | GCCTCACAAAAGCGGCAGGACAT (SEQ ID NO: 3745) |
| 95 | C | OBD159_3245 | CCTCCTGTCACTGCTCCTGAAAC (SEQ ID NO: 3863) | OBD159_3247 | GTGAGGCTTGCTGATTGGGCAGTC (SEQ ID NO: 3900) |
| 96 | C | OBD159_3313 | GGGTCACTTCCCCTCATTTTCCCC (SEQ ID NO: 3864) | OBD159_3315 | TTGGAGCAAGAAAGGGAGGCACG (SEQ ID NO: 3901) |
| 97 | C | OBD159_3353 | CATTACAAAGCAGTTGGGAAGAAGGG (SEQ ID NO: 3865) | OBD159_3355 | GGAGTCCACTGAGGCAGAGTAGAGAA (SEQ ID NO: 3902) |
| 98 | C | OBD159_3257 | CGTATGGGTTTGTTTGTGTGTGGGTT (SEQ ID NO: 3866) | OBD159_3259 | CAGTCATCTCATTCACACATTGCCTG (SEQ ID NO: 3903) |
| 99 | C | OBD159_3161 | GATTAGAAACACAAGAGACCAGAGGC (SEQ ID NO: 3867) | OBD159_3163 | AGCAGGGAGAGCATTAGACCATTGTC (SEQ ID NO: 3904) |
| 100 | C | OBD159_3301 | AGCACAGAGGCAGAGGGAGGAAG (SEQ ID NO: 3868) | OBD159_3303 | GTGGTTGGTGGACCTGGCAAAAG (SEQ ID NO: 3905) |
| 101 | C | OBD159_3341 | GGTGCGGGATTCAGACCTTCAGC (SEQ ID NO: 3675) | OBD159_3343 | GCAGGCACAATCCTTCCCAATGC (SEQ ID NO: 3726) |
| 102 | C | OBD159_3237 | GGTGCGGGATTCAGACCTTCAGC (SEQ ID NO: 3675) | OBD159_3239 | CAAGTGCTTCCTGAGGTGACTGC (SEQ ID NO: 3735) |

TABLE 8.3a

| No. | Group | Probe | GeneLocus | Probe_Count_Total |
|---|---|---|---|---|
| 103 | C | ORF14_7_106136911_106139119_106155635_106157326_RR | N/A | N/A |
| 104 | C | ORF154_20_8536736_8541378_8617739_8619868_RR | N/A | N/A |
| 105 | C | ORF13_4_143433910_143437405_143448534_143453407_FF | N/A | N/A |
| 106 | C | ORF174_6_27413034_27418482_27440151_27442553_FR | N/A | N/A |
| 107 | C | ORF141_7_10116043_10123567_10183118_10197721_RF | N/A | N/A |
| 108 | C | ORF16_14_25540524_25542178_25611611_25628347_RR | N/A | N/A |
| 109 | C | ORF13_18_11120542_11126658_11179423_11180892_FF | N/A | N/A |
| 110 | C | ORF11_4_125340607_125343598_125382298_125392915_FF | N/A | N/A |
| 111 | C | ORF184_5_58015461_58023944_58085103_58086932_RF | N/A | N/A |
| 112 | C | ORF118_2_227923203_227932124_227972103_227976215_FF | N/A | N/A |
| 113 | C | ORF19_12_4449560_4457960_4518174_4519818_FR | N/A | N/A |
| 114 | C | ORF112_9_105368835_105370455_105414393_105415801_FF | N/A | N/A |
| 115 | C | ORF116_2_209634852_209638927_209684451_209692640_FF | N/A | N/A |
| 116 | C | ORF172_9_8138555_8143223_8167171_8181381_FF | N/A | N/A |
| 117 | C | ORF13_2_106158642_106160954_106232485_106234911_FR | N/A | N/A |
| 118 | C | ORF128_5_42377041_42385919_42438799_42441730_FR | N/A | N/A |
| 119 | C | ORF12_16_27236516_27245702_27324505_27326522_FF | N/A | N/A |
| 120 | C | ORF186_1_111517187_111519912_111535220_111538688_RR | N/A | N/A |
| 121 | C | ORF102_9_8811961_8818994_8886566_8895563_FF | N/A | N/A |
| 122 | C | ORF194_6_155219095_155222285_155266642_155272264_RF | N/A | N/A |
| 123 | C | ORF153_2_38148629_38155476_38179203_38180978_RF | N/A | N/A |
| 124 | C | ORF176_2_174770802_174773897_174874107_174881547_FF | N/A | N/A |
| 125 | C | ORF12_13_27276527_27282043_27312084_27318228_RR | N/A | N/A |
| 126 | C | ORF16_7_111035039_111042953_111093152_111098806_RR | N/A | N/A |
| 127 | C | ORF14_2_106158642_106160954_106232485_106234911_RR | N/A | N/A |
| 128 | C | ORF193_7_110903831_110929891_110971827_110980437_FR | N/A | N/A |
| 129 | C | ORF1_5_176613477_176617551_176680676_176682882_RF | N/A | N/A |
| 130 | C | ORF18_7_106136911_106139119_106183992_106185753_RR | N/A | N/A |
| 131 | C | ORF142_20_8536736_8541378_8588020_8590421_FR | N/A | N/A |
| 132 | C | ORF175_4_20552692_20562244_20609595_20612048_FF | N/A | N/A |
| 133 | C | ORF130_20_21483562_21487561_21556998_21560005_FF | N/A | N/A |
| 134 | C | ORF13_20_10323987_10325423_10353508_10357454_RR | N/A | N/A |
| 135 | C | ORF12_7_22368712_22370568_22401546_22402661_RR | N/A | N/A |
| 136 | C | ORF192_5_79070482_79071656_79131598_79144935_RR | N/A | N/A |
| 137 | C | ORF145_1_229817736_229820596_229849427_229855718_FF | N/A | N/A |
| 138 | C | ORF162_6_61648546_61654260_61702551_61716000_RF | N/A | N/A |
| 139 | B | ORF194_11_44526701_44529279_44604674_44605773_RF | N/A | N/A |
| 140 | B | ORF16_3_46479747_46488239_46559199_46566649_FR | N/A | N/A |

TABLE 8.3a-continued

| No. | Group | Probe | GeneLocus | Probe_Count_Total |
|---|---|---|---|---|
| 141 | B | ORF184_2_209614911_209618135_209684451_209692640_RF | N/A | N/A |
| 142 | B | ORF13_7_106136911_106139119_106190436_106195694_RR | N/A | N/A |
| 143 | B | ORF155_1_111472532_111477653_111535220_111538688_RR | N/A | N/A |
| 144 | B | ORF128_6_68648483_68653667_68703842_68708467_FF | N/A | N/A |
| 145 | B | ORF127_15_88349285_88356402_88400169_88403416_FF | N/A | N/A |
| 146 | B | ORF11_5_176613477_176617551_176666420_176668727_RF | N/A | N/A |
| 147 | B | ORF193_14_100323802_100329446_100399165_100403839_RR | N/A | N/A |
| 148 | B | ORF11_17_1986444_1988214_2093493_2096428_RR | N/A | N/A |
| 149 | B | ORF18_4_151954708_151965424_152011202_152016397_FF | N/A | N/A |
| 150 | B | ORF199_5_124405371_124409805_124446457_124450050_RR | N/A | N/A |
| 151 | B | ORF108_11_120066945_120072959_120088100_120090309_RF | N/A | N/A |
| 152 | B | ORF16_7_106136911_106139119_106195694_106199610_RR | N/A | N/A |
| 153 | B | ORF1_6_163982666_163985777_164038165_164043521_FR | N/A | N/A |

TABLE 8.3b

| No. | Group | Probe_Count_Sig | HyperG_Stats | FDR_HyperG | Percent_Sig | logFC | AveExpr |
|---|---|---|---|---|---|---|---|
| 103 | C | N/A | N/A | N/A | N/A | −0.640045509 | −0.640045509 |
| 104 | C | N/A | N/A | N/A | N/A | −0.636079084 | −0.636079084 |
| 105 | C | N/A | N/A | N/A | N/A | −0.633852595 | −0.633852595 |
| 106 | C | N/A | N/A | N/A | N/A | −0.626929583 | −0.626929583 |
| 107 | C | N/A | N/A | N/A | N/A | −0.624063051 | −0.624063051 |
| 108 | C | N/A | N/A | N/A | N/A | −0.623948872 | −0.623948872 |
| 109 | C | N/A | N/A | N/A | N/A | −0.623902455 | −0.623902455 |
| 110 | C | N/A | N/A | N/A | N/A | −0.622920918 | −0.622920918 |
| 111 | C | N/A | N/A | N/A | N/A | −0.621282612 | −0.621282612 |
| 112 | C | N/A | N/A | N/A | N/A | −0.620914449 | −0.620914449 |
| 113 | C | N/A | N/A | N/A | N/A | −0.618133467 | −0.618133467 |
| 114 | C | N/A | N/A | N/A | N/A | −0.616696521 | −0.616696521 |
| 115 | C | N/A | N/A | N/A | N/A | −0.614015867 | −0.614015867 |
| 116 | C | N/A | N/A | N/A | N/A | −0.612905757 | −0.612905757 |
| 117 | C | N/A | N/A | N/A | N/A | −0.611470158 | −0.611470158 |
| 118 | C | N/A | N/A | N/A | N/A | −0.610708394 | −0.610708394 |
| 119 | C | N/A | N/A | N/A | N/A | −0.609828418 | −0.609828418 |
| 120 | C | N/A | N/A | N/A | N/A | −0.607675757 | −0.607675757 |
| 121 | C | N/A | N/A | N/A | N/A | −0.607005611 | −0.607005611 |
| 122 | C | N/A | N/A | N/A | N/A | −0.606425108 | −0.606425108 |
| 123 | C | N/A | N/A | N/A | N/A | −0.605617232 | −0.605617232 |
| 124 | C | N/A | N/A | N/A | N/A | −0.604838546 | −0.604838546 |
| 125 | C | N/A | N/A | N/A | N/A | −0.60275613 | −0.60275613 |
| 126 | C | N/A | N/A | N/A | N/A | −0.599633345 | −0.599633345 |
| 127 | C | N/A | N/A | N/A | N/A | −0.599240184 | −0.599240184 |
| 128 | C | N/A | N/A | N/A | N/A | −0.598938813 | −0.598938813 |
| 129 | C | N/A | N/A | N/A | N/A | −0.598849944 | −0.598849944 |
| 130 | C | N/A | N/A | N/A | N/A | −0.59571577 | −0.59571577 |
| 131 | C | N/A | N/A | N/A | N/A | −0.594864882 | −0.594864882 |
| 132 | C | N/A | N/A | N/A | N/A | −0.594826085 | −0.594826085 |
| 133 | C | N/A | N/A | N/A | N/A | −0.591728575 | −0.591728575 |
| 134 | C | N/A | N/A | N/A | N/A | −0.59170328 | −0.59170328 |
| 135 | C | N/A | N/A | N/A | N/A | −0.590934742 | −0.590934742 |
| 136 | C | N/A | N/A | N/A | N/A | −0.587372199 | −0.587372199 |
| 137 | C | N/A | N/A | N/A | N/A | −0.587330628 | −0.587330628 |
| 138 | C | N/A | N/A | N/A | N/A | −0.585923665 | −0.585923665 |
| 139 | B | N/A | N/A | N/A | N/A | −0.58297402 | −0.58297402 |
| 140 | B | N/A | N/A | N/A | N/A | −0.58250559 | −0.58250559 |
| 141 | B | N/A | N/A | N/A | N/A | −0.581621332 | −0.581621332 |
| 142 | B | N/A | N/A | N/A | N/A | −0.581020972 | 0.581020972 |
| 143 | B | N/A | N/A | N/A | N/A | −0.580266284 | −0.580266284 |
| 144 | B | N/A | N/A | N/A | N/A | −0.57890323 | −0.57890323 |
| 145 | B | N/A | N/A | N/A | N/A | −0.57811455 | −0.57811455 |
| 146 | B | N/A | N/A | N/A | N/A | −0.577795827 | −0.577795827 |
| 147 | B | N/A | N/A | N/A | N/A | −0.577359947 | −0.577359947 |
| 148 | B | N/A | N/A | N/A | N/A | −0.576844081 | −0.576844081 |
| 149 | B | N/A | N/A | N/A | N/A | −0.576623587 | −0.576623587 |
| 150 | B | N/A | N/A | N/A | N/A | −0.576363817 | −0.576363817 |
| 151 | B | N/A | N/A | N/A | N/A | −0.575891957 | −0.575891957 |
| 152 | B | N/A | N/A | V/A | N/A | −0.575472897 | −0.575472897 |
| 153 | B | N/A | N/A | N/A | N/A | −0.575114016 | −0.575114016 |

TABLE 8.3c

| No. | Group | t | P.Value | adj.P.Val | B | FC |
|---|---|---|---|---|---|---|
| 103 | C | −3.814902652 | 0.002468744 | 0.008765033 | −2.033185207 | 0.641692706 |
| 104 | C | −6.16266968 | 0.0000488 | 0.000501213 | 1.997735418 | 0.64345935 |
| 105 | C | −8.766625485 | 0.00000147 | 0.0000511 | 5.60909361 | 0.644453158 |
| 106 | C | −6.87730155 | 0.0000172 | 0.000249494 | 3.077788278 | 0.647553105 |
| 107 | C | −3.712475281 | 0.002974803 | 0.010131836 | −2.222055083 | 0.648841026 |
| 108 | C | −8.345138114 | 0.00000246 | 0.0000702 | 5.082406652 | 0.648892379 |
| 109 | C | −8.905181362 | 0.00000125 | 0.0000458 | 5.777814484 | 0.648913257 |
| 110 | C | −6.306530562 | 0.0000394 | 0.000431581 | 2.220905953 | 0.649354895 |
| 111 | C | −5.229436725 | 0.00021248 | 0.001418673 | 0.479128889 | 0.650092713 |
| 112 | C | −4.984094922 | 0.000319131 | 0.001915337 | 0.059957021 | 0.650258632 |
| 113 | C | −9.214496212 | 0.000000871 | 0.0000367 | 6.146852964 | 0.651513299 |
| 114 | C | −4.395680482 | 0.000875115 | 0.00404284 | −0.976058903 | 0.652162539 |
| 115 | C | −5.830333035 | 0.0000813 | 0.000715489 | 1.470987158 | 0.653375441 |
| 116 | C | −11.35869544 | 0.0000000903 | 0.00000925 | 8.444373849 | 0.653878387 |
| 117 | C | 18.24832932 | 0.00000000415 | 0.000000642 | 13.64976188 | 0.654529373 |
| 118 | C | −5.825733101 | 0.0000819 | 0.000718842 | 1.463586606 | 0.654875065 |
| 119 | C | −6.877520094 | 0.0000172 | 0.000249458 | 3.078107745 | 0.65527463 |
| 120 | C | −12.30291776 | 0.0000000372 | 0.00000569 | 9.33032888 | 0.656253102 |
| 121 | C | −3.834281763 | 0.002383418 | 0.008532895 | −1.997511072 | 0.656558009 |
| 122 | C | −8.597686222 | 0.00000180 | 0.0000578 | 5.400446867 | 0.656822244 |
| 123 | C | −12.45917871 | 0.0000000323 | 0.00000530 | 9.47046222 | 0.657190153 |
| 124 | C | −8.630824333 | 0.00000173 | 0.0000565 | 5.441630153 | 0.657544963 |
| 125 | C | −6.266523248 | 0.0000418 | 0.000448841 | 2.159136079 | 0.658494762 |
| 126 | C | −4.358035947 | 0.000934874 | 0.004228836 | −1.043673578 | 0.659921651 |
| 127 | C | −14.67403678 | 0.00000000509 | 0.00000207 | 11.28238735 | 0.660101516 |
| 128 | C | −4.543549457 | 0.000676271 | 0.0033356 | −0.711917511 | 0.660239422 |
| 129 | C | −3.785290802 | 0.002605235 | 0.00914021 | −2.087735118 | 0.660280093 |
| 130 | C | −3.89750471 | 0.002125545 | 0.00784286 | −1.881277291 | 0.661716074 |
| 131 | C | −7.818730494 | 0.00000480 | 0.000107796 | 4.394984269 | 0.662106463 |
| 132 | C | −7.69396267 | 0.00000564 | 0.000119627 | 4.227033097 | 0.662124269 |
| 133 | C | −5.234115134 | 0.000210856 | 0.00141049 | 0.487043936 | 0.663547397 |
| 134 | C | −9.447799994 | 0.000000667 | 0.0000310 | 6.418432274 | 0.663559031 |
| 135 | C | −6.338534374 | 0.0000375 | 0.000417454 | 2.270156333 | 0.66391261 |
| 136 | C | −6.484220917 | 0.0000303 | 0.000361081 | 2.492533035 | 0.665554079 |
| 137 | C | −6.445699918 | 0.0000320 | 0.000375266 | 2.43402391 | 0.665573257 |
| 138 | C | −5.544376271 | 0.00012762 | 0.000983373 | 1.005255977 | 0.666222662 |
| 139 | B | −11.62179099 | 0.0000000701 | 0.00000803 | 8.698220728 | 0.667586174 |
| 140 | B | −8.387351643 | 0.00000233 | 0.0000681 | 5.136086408 | 0.667802968 |
| 141 | B | −8.327361769 | 0.00000251 | 0.0000712 | 5.059738807 | 0.668212404 |
| 142 | B | −3.78437398 | 0.002609582 | 0.00915144 | −2.089424776 | 0.66849053 |
| 143 | B | −11.91770856 | 0.0000000530 | 0.00000684 | 8.977187098 | 0.668840316 |
| 144 | B | −8.663189614 | 0.00000167 | 0.0000552 | 5.481731704 | 0.669472532 |
| 145 | B | −7.289339635 | 0.00000970 | 0.00017077 | 3.668636027 | 0.669838614 |
| 146 | B | −5.079540206 | 0.000272154 | 0.001702011 | 0.223974519 | 0.669986612 |
| 147 | B | −7.53374465 | 0.00000698 | 0.000137076 | 4.008459114 | 0.670189065 |
| 148 | B | −5.835924402 | 0.0000806 | 0.000711241 | 1.479978735 | 0.670428749 |
| 149 | B | −10.16540863 | 0.000000304 | 0.0000191 | 7.219100586 | 0.670531221 |
| 150 | B | −8.15126985 | 0.00000313 | 0.0000818 | 4.833156506 | 0.670651967 |
| 151 | B | −4.291941295 | 0.001050276 | 0.0046232 | −1.16273352 | 0.670871352 |
| 152 | B | −4.027542945 | 0.001681609 | 0.006570265 | −1.64302313 | 0.671066248 |
| 153 | B | −3.202067087 | 0.007616825 | 0.02095053 | −3.166725894 | 0.671233202 |

TABLE 8.3d

| No. | Group | FC_1 | LS | Loop Detected |
|---|---|---|---|---|
| 103 | C | −1.558378317 | −1 | Severe Autism |
| 104 | C | −1.554099726 | −1 | Severe Autism |
| 105 | C | −1.551703158 | −1 | Severe Autism |
| 106 | C | −1.54427489 | −1 | Severe Autism |
| 107 | C | −1.541209572 | −1 | Severe Autism |
| 108 | C | −1.541087601 | −1 | Severe Autism |
| 109 | C | −1.541038019 | −1 | Severe Autism |
| 110 | C | −1.539989931 | −1 | Severe Autism |
| 111 | C | −1.53824213 | −1 | Severe Autism |
| 112 | C | −1.537849635 | −1 | Severe Autism |
| 113 | C | −1.534888085 | −1 | Severe Autism |
| 114 | C | −1.533360075 | −1 | Severe Autism |
| 115 | C | −1.530513603 | −1 | Severe Autism |
| 116 | C | −1.529336372 | −1 | Severe Autism |
| 117 | C | −1.527815315 | −1 | Severe Autism |
| 118 | C | −1.527008819 | −1 | Severe Autism |
| 119 | C | −1.526077699 | −1 | Severe Autism |
| 120 | C | −1.52380232 | −1 | Severe Autism |
| 121 | C | −1.523094664 | −1 | Severe Autism |

TABLE 8.3d-continued

| No. | Group | FC_1 | LS | Loop Detected |
|---|---|---|---|---|
| 122 | C | −1.522481933 | −1 | Severe Autism |
| 123 | C | −1.521629617 | −1 | Severe Autism |
| 124 | C | −1.520808548 | −1 | Severe Autism |
| 125 | C | −1.518614965 | −1 | Severe Autism |
| 126 | C | −1.515331402 | −1 | Severe Autism |
| 127 | C | −1.514918502 | −1 | Severe Autism |
| 128 | C | −1.514602078 | −1 | Severe Autism |
| 129 | C | −1.514508782 | −1 | Severe Autism |
| 130 | C | −1.511222168 | −1 | Severe Autism |
| 131 | C | −1.510331126 | −1 | Severe Autism |
| 132 | C | −1.510290511 | −1 | Severe Autism |
| 133 | C | −1.50705135 | −1 | Severe Autism |
| 134 | C | −1.507024927 | −1 | Severe Autism |
| 135 | C | −1.506222333 | −1 | Severe Autism |
| 136 | C | −1.502507507 | −1 | Severe Autism |
| 137 | C | −1.502464213 | −1 | Severe Autism |
| 138 | C | −1.500999676 | −1 | Severe Autism |
| 139 | B | −1.497933959 | −1 | Severe Autism |
| 140 | B | −1.497447673 | −1 | Severe Autism |

TABLE 8.3d-continued

| No. | Group | FC_1 | LS | Loop Detected |
|-----|-------|------|-----|--------------|
| 141 | B | −1.496530137 | −1 | Severe Autism |
| 142 | B | −1.495907503 | −1 | Severe Autism |
| 143 | B | −1.495125184 | −1 | Severe Autism |
| 144 | B | −1.493713262 | −1 | Severe Autism |
| 145 | B | −1.492896914 | −1 | Severe Autism |
| 146 | B | −1.492567137 | −1 | Severe Autism |
| 147 | B | −1.492116258 | −1 | Severe Autism |

TABLE 8.3d-continued

| No. | Group | FC_1 | LS | Loop Detected |
|-----|-------|------|-----|--------------|
| 148 | B | −1.491582815 | −1 | Severe Autism |
| 149 | B | −1.491354867 | −1 | Severe Autism |
| 150 | B | −1.491086359 | −1 | Severe Autism |
| 151 | B | −1.490598752 | −1 | Severe Autism |
| 152 | B | −1.490165841 | −1 | Severe Autism |
| 153 | B | −1.489795197 | −1 | Severe Autism |

TABLE 8.3e

| No. | Group | Probe sequence 60 mer | Probe Location Chr |
|-----|-------|-----------------------|--------------------|
| 103 | C | CTCACCACCTCCTAGCTATGACCCTTGGTCGATTCTCAATGTCTACGTGGACTAACTCAT (SEQ ID NO: 3908) | 7 |
| 104 | C | TATGGTAAAATGGATTCTCTCTCAGTTCTCGAAGTGGAATTGTGAATCTTCCAATCGTCT (SEQ ID NO: 3909) | 20 |
| 105 | C | GGAGTTGGTTAACTCTGTATCACGTATTTCGAGTTCTTCTTCATCTTCATTACCTTTTTT (SEQ ID NO: 3910) | 4 |
| 106 | C | TCAATTCATTGATTAGGTAAATTTGTATTCGATAAAGTGGATGAACTGATTTTTAGCTAA (SEQ ID NO: 3911) | 6 |
| 107 | C | TGGTTTTCCCTTCCTTTGTTACTTCACTTCGAAAGATGTTGAGTCTATCTGTAACTCAGA (SEQ ID NO: 3912) | 7 |
| 108 | C | TCACATATTCATCTTCTCTCTCTTGCTATCGAATCTGATACTCTCTGCCTTTGAACTGGG (SEQ ID NO: 3913) | 14 |
| 109 | C | ATATTTTTTTTTTTTTGTATTCCCAGAATCGACTTCTTCTGTTAGATGCTTGAGATGGAT (SEQ ID NO: 3914) | 18 |
| 110 | C | TTTTGAACACATTTTTAAAACTCTGAGTTCGAGGGCACTGATTTTTCCAGAGTAGTGGAG (SEQ ID NO: 3915) | 4 |
| 111 | C | CAAATATCCTAATAAACAAATTCCTGTGTCGATTCCTTTGTTTTCTGCATATTGGGACAC (SEQ ID NO: 3916) | 5 |
| 112 | C | TCTATATAAGAAATTCGTAGGATGAATATCGAATGAAACTAACAGAGGAAGAAAAACATT (SEQ ID NO: 3917) | 2 |
| 113 | C | AATCACATACTAACATCTCTCATGAAAATCGATGATTTCTTTTATGCTTACAGAAGTCCA (SEQ ID NO: 3918) | 12 |
| 114 | C | CCTTTTAAAAGGCTAAATTTCTGGACATTCGAAGGACAATATTCTTCAAGTATATATTGT (SEQ ID NO: 3919) | 9 |
| 115 | C | TAAGATACTAGAAACCAACATAAATTAATCGAGGCTGTAAGTAAATCTGAAGTAATCGGG (SEQ ID NO: 3920) | 2 |
| 116 | C | CCCCACTCTGCCCTCAATTGTGGTTCATTCGATAAATATGTGTTGAATCTAAGAGAGTGT (SEQ ID NO: 3921) | 9 |
| 117 | C | AAAAAACTATCTTATACTCCTCACTTCTTCGACTCGCTGACACCACCCCACCCCACCCCT (SEQ ID NO: 3922) | 2 |
| 118 | C | ATGCTAAATTATGTAAAATGGAATATGTTCGAGATGACTGCAGTCTTCCACCAACAGCTT (SEQ ID NO: 3923) | 5 |
| 119 | C | CTGTCAATTCTGTATGTTGAGAAATTCATCGAATAATTTTTAAATTTTTGTAGAGATGGG (SEQ ID NO: 3924) | 16 |
| 120 | C | GGACTCAGTCTCTCCAGGAGAGACTTTATCGAAATGTATCCACCCACCCCACCTCTAAAC (SEQ ID NO: 3925) | 1 |
| 121 | C | CACTCTAGTCCACTACTAGTTGCAATGTTCGATTTTATTTATTCATAGTGAGTTGAAGTC (SEQ ID NO: 3926) | 9 |
| 122 | C | AAGAATAGGTCTTTCGGTATTATTTAGTTCGAAGTTAGTGTCAGTGGTCAACTTCTCCCG (SEQ ID NO: 3927) | 6 |
| 123 | C | CTAGATTCCCAGAAGAAAGATTACTGATTCGATCATTGCTCAATGACCAAGTCACAAAGT (SEQ ID NO: 3928) | 2 |

TABLE 8.3e-continued

| No. | Group | Probe sequence 60 mer | Probe Location Chr |
|-----|-------|----------------------|---------------------|
| 124 | C | TTGCATTGGTGCAAAAAATGCAATCAAATCGAGCCTACTATATATATTTAGCTTTGACTT (SEQ ID NO: 3929) | 2 |
| 125 | C | TATTATAATTGACTTATTTTTCCATTATTCGAAGTCCATAGTTGACATTATAATTCAGTC (SEQ ID NO: 3930) | 13 |
| 126 | C | TGTTTTCTTTTAACATCCTATTATTGACTCGATTTTCTCTCTGTAAGATGAACAAGTTTA (SEQ ID NO: 3931) | 7 |
| 127 | C | ACCTCGGCTTAGGAATGTGGCTTCAATCTCGACTCGCTGACACCACCCCACCCCACCCCT (SEQ ID NO: 3932) | 2 |
| 128 | C | TCATGAAATGATTGAGTTGTGAATTTCATCGAGATATGCATTATTAATGTTTAAACTGTG (SEQ ID NO: 3933) | 7 |
| 129 | C | ATGTAATCATCATCATCATACTTTATAATCGATATCATCCTATACAATGCTTAGCTCTCA (SEQ ID NO: 3934) | 5 |
| 130 | C | CTCACCACCTCCTAGCTATGACCCTTGGTCGATTCAATTGCTAGGCAGATGTCCTTGTAG (SEQ ID NO: 3935) | 7 |
| 131 | C | GATGAGTAACATAGTAGAAAAAAATACTTCGAAACTGTCACTCTGGTGTTGAGATAAATA (SEQ ID NO: 3936) | 20 |
| 132 | C | CTTATCTTTATTTGCTGTCTTTACATCTTCGAAAGATTTAATGAAGTGGATTCTAATGAA (SEQ ID NO: 3937) | 4 |
| 133 | C | TTATCTTTATAAATCATACCATATAGCTTCGACTCCAAATGCAGAATGTAACTCATGAGC (SEQ ID NO: 3938) | 20 |
| 134 | C | TCTTCTAAAGACAAGTCCCAGTTTAAGATCGATGAATTCAAGGAAATATATTCAGGTCAC (SEQ ID NO: 3939) | 20 |
| 135 | C | TGAATTTATTTCATGTTCTCTTCTAATGTCGAATTACAGTCTCAGGCTTGACAAAACCTA (SEQ ID NO: 3940) | 7 |
| 136 | C | CACTCCTTCATCCCACCCCCACACATACTCGAAATTAAATGTGTGATCCATCCTAGTATT (SEQ ID NO: 3941) | 5 |
| 137 | C | GATTTCAATGTAGATCTTCAAACTCTCATCGATTTTTCAATGTTTGTGACAAAACCGGTT (SEQ ID NO: 3942) | 1 |
| 138 | C | TAAAATGGCTACATTTTTTTTTTCCATTCTCGAATTTAGAGATGAACACACGTTCTGCCTC (SEQ ID NO: 3943) | 6 |
| 139 | B | GAACTCTCAGAGTGGTTGCAAAGATTATTCGACCCGCTTTCCTCCCCGCCCCCTCATCCG (SEQ ID NO: 3944) | 11 |
| 140 | B | CTGGGTACCCTTATGTAAAATAAATTTATCGACTTAAAAGTCTCCATAAAGGAACGCTAC (SEQ ID NO: 3945) | 3 |
| 141 | B | CCCGATTACTTCAGATTTACTTACAGCCTCGATGAACTTCCTCTGCTTCTAGAGCTTTTA (SEQ ID NO: 3946) | 2 |
| 142 | B | CTCACCACCTCCTAGCTATGACCCTTGGTCGATAAGAAAGACTGTATTCTCAAGGAATTC (SEQ ID NO: 3947) | 7 |
| 143 | B | AAGGAGTGCACATTTCCACTTAGAGAACTCGAAATGTATCCACCCACCCCACCTCTAAAC (SEQ ID NO: 3948) | 1 |
| 144 | B | AGACTATTCTTTCAACATTTAAAGATACTCGAGGACAGGGAATAGAAATGCTTTCAAAGA (SEQ ID NO: 3949) | 6 |
| 145 | B | ATGAGTCAAGAATTCAGAAAGAGTGCAATCGACCTACATTTTCTTTGTCTTTGTAATGGA (SEQ ID NO: 3950) | 15 |
| 146 | B | TCAATTTATTGAGTCTAATTTACATACATCGATATCATCCTATACAATGCTTAGCTCTCA (SEQ ID NO: 3951) | 5 |
| 147 | B | CATCTTCCCTACCCATCTCCCCACCCTCTCGAATTTAGACTGCTTACCACATTGATGTTT (SEQ ID NO: 3952) | 14 |
| 148 | B | TTATCTCAAGATCTTTAACTTAATTACATCGATAATTGAGCAGCTGGCATTTTTTTTTCC (SEQ ID NO: 3953) | 17 |
| 149 | B | TTCCCCACTGCCTCCCATCCTTTATCTCTCGAAGTAGTCCTTGTACCTACCATGATCATC (SEQ ID NO: 3954) | 4 |

TABLE 8.3e-continued

| No. | Group | Probe sequence 60 mer | Probe Location Chr |
|-----|-------|----------------------|--------------------|
| 150 | B | ATATTCTTTCAATATTTGTACATTTATATCGAAGCAGAGATGTCTTGCAGTCAGAGTCAA (SEQ ID NO: 3955) | 5 |
| 151 | B | CACAGAATAGACTCTCAGTAAATAACTATCGAATTTAATCTGCGTCTGATATGCTGGCAG (SEQ ID NO: 3956) | 11 |
| 152 | B | CTCACCACCTCCTAGCTATGACCCTTGGTCGACAAGAGCCTCCTGACAGGTCTGCCTGCC (SEQ ID NO: 3957) | 7 |
| 153 | B | TCAATCAGGAATCACTGTAAATATTGACTCGAGGTGTAGAGAAAACCCTGGAAGGGGGGT (SEQ ID NO: 3958) | 6 |

TABLE 8.3f

| No. | Group | Probe Location | | | | 4 kb Sequence Location | |
|-----|-------|--------|--------|--------|--------|-----|--------|
| | | Start1 | End1 | Start2 | End2 | Chr | Start1 |
| 103 | C | 106136913 | 106136942 | 106155637 | 106155666 | 7 | 106136913 |
| 104 | C | 8536738 | 8536767 | 8617741 | 8617770 | 20 | 8536738 |
| 105 | C | 143437374 | 143437403 | 143453376 | 143453405 | 4 | 143433404 |
| 106 | C | 27418451 | 27418480 | 27440153 | 27440182 | 6 | 27414481 |
| 107 | C | 10116045 | 10116074 | 10197690 | 10197719 | 7 | 10116045 |
| 108 | C | 25540526 | 25540555 | 25611613 | 25611642 | 14 | 25540526 |
| 109 | C | 11126627 | 11126656 | 11180861 | 11180890 | 18 | 11122657 |
| 110 | C | 125343567 | 125343596 | 125392884 | 125392913 | 4 | 125339597 |
| 111 | C | 58015463 | 58015492 | 58086901 | 58086930 | 5 | 58015463 |
| 112 | C | 227932093 | 227932122 | 227976184 | 227976213 | 2 | 227928123 |
| 113 | C | 4457929 | 4457958 | 4518176 | 4518205 | 12 | 4453959 |
| 114 | C | 105370424 | 105370453 | 105415770 | 105415799 | 9 | 105366454 |
| 115 | C | 209638896 | 209638925 | 209692609 | 209692638 | 2 | 209634926 |
| 116 | C | 8143192 | 8143221 | 8181350 | 8181379 | 9 | 8139222 |
| 117 | C | 106160923 | 106160952 | 106232487 | 106232516 | 2 | 106156953 |
| 118 | C | 42385888 | 42385917 | 42438801 | 42438830 | 5 | 42381918 |
| 119 | C | 27245671 | 27245700 | 27326491 | 27326520 | 16 | 27241701 |
| 120 | C | 111517189 | 111517218 | 111535222 | 111535251 | 1 | 111517189 |
| 121 | C | 8818963 | 8818992 | 8895532 | 8895561 | 9 | 8814993 |
| 122 | C | 155219097 | 155219126 | 155272233 | 155272262 | 6 | 155219097 |
| 123 | C | 38148631 | 38148660 | 38180947 | 38180976 | 2 | 38148631 |
| 124 | C | 174773866 | 174773895 | 174881516 | 174881545 | 2 | 174769896 |
| 125 | C | 27276529 | 27276558 | 27312086 | 27312115 | 13 | 27276529 |
| 126 | C | 111035041 | 111035070 | 111093154 | 111093183 | 7 | 111035041 |
| 127 | C | 106158644 | 106158673 | 106232487 | 106232516 | 2 | 106158644 |
| 128 | C | 110929860 | 110929889 | 110971829 | 110971858 | 7 | 110925890 |
| 129 | C | 176613479 | 176613508 | 176682851 | 176682880 | 5 | 176613479 |
| 130 | C | 106136913 | 106136942 | 106183994 | 106184023 | 7 | 106136913 |
| 131 | C | 8541347 | 8541376 | 8588022 | 8588051 | 20 | 8537377 |
| 132 | C | 20562213 | 20562242 | 20612017 | 20612046 | 4 | 20558243 |
| 133 | C | 21487530 | 21487559 | 21559974 | 21560003 | 20 | 21483560 |
| 134 | C | 10323989 | 10324018 | 10353510 | 10353539 | 20 | 10323989 |
| 135 | C | 22368714 | 22368743 | 22401548 | 22401577 | 7 | 22368714 |
| 136 | C | 79070484 | 79070513 | 79131600 | 79131629 | 5 | 79070484 |
| 137 | C | 229820565 | 229820594 | 229855687 | 229855716 | 1 | 229816595 |
| 138 | C | 61648548 | 61648577 | 61715969 | 61715998 | 6 | 61648548 |
| 139 | B | 44526703 | 44526732 | 44605742 | 44605771 | 11 | 44526703 |
| 140 | B | 46488208 | 46488237 | 46559201 | 46559230 | 3 | 46484238 |
| 141 | B | 209614913 | 209614942 | 209692609 | 209692638 | 2 | 209614913 |
| 142 | B | 106136913 | 106136942 | 106190438 | 106190467 | 7 | 106136913 |
| 143 | B | 111472534 | 111472563 | 111535222 | 111535251 | 1 | 111472534 |
| 144 | B | 68653636 | 68653665 | 68708436 | 68708465 | 6 | 68649666 |
| 145 | B | 88356371 | 88356400 | 88403385 | 88403414 | 15 | 88352401 |
| 146 | B | 176613479 | 176613508 | 176668696 | 176668725 | 5 | 176613479 |
| 147 | B | 100323804 | 100323833 | 100399167 | 100399196 | 14 | 100323804 |
| 148 | B | 1986446 | 1986475 | 2093495 | 2093524 | 17 | 1986446 |
| 149 | B | 151965393 | 151965422 | 152016366 | 152016395 | 4 | 151961423 |
| 150 | B | 124405373 | 124405402 | 124446459 | 124446488 | 5 | 124405373 |
| 151 | B | 120066947 | 120066976 | 120090278 | 120090307 | 11 | 120066947 |
| 152 | B | 106136913 | 106136942 | 106195696 | 106195725 | 7 | 106136913 |
| 153 | B | 163985746 | 163985775 | 164038167 | 164038196 | 6 | 163981776 |

TABLE 8.3g

| No. | Group | End1 | Start2 | End2 | Probe |
|---|---|---|---|---|---|
| 103 | C | 106140912 | 106155637 | 106159636 | ORF14_7_106136911_106139119_106155635_106157326_RR |
| 104 | C | 8540737 | 8617741 | 8621740 | ORF154_20_8536736_8541378_8617739_8619868_RR |
| 105 | C | 143437403 | 143449406 | 143453405 | ORF13_4_143433910_143437405_143448534_143453407_FF |
| 106 | C | 27418480 | 27440153 | 27444152 | ORF174_6_27413034_27418482_27440151_27442553_FR |
| 107 | C | 10120044 | 10193720 | 10197719 | ORF141_7_10116043_10123567_10183118_10197721_RF |
| 108 | C | 25544525 | 25611613 | 25615612 | ORF16_14_25540524_25542178_25611611_25628347_RR |
| 109 | C | 11126656 | 11176891 | 11180890 | ORF13_18_11120542_11126658_11179423_11180892_FF |
| 110 | C | 125343596 | 125388914 | 125392913 | ORF11_4_125340607_125343598_125382298_125392915_FF |
| 111 | C | 58019462 | 58082931 | 58086930 | ORF184_5_58015461_58023944_58085103_58086932_FF |
| 112 | C | 227932122 | 227972214 | 227976213 | ORF118_2_227923203_227932124_227972103_227976215_FF |
| 113 | C | 4457958 | 4518176 | 4522175 | ORF19_12_4449560_4457960_4518174_4519818_FR |
| 114 | C | 105370453 | 105411800 | 105415799 | ORF112_9_105368835_105370455_105414393_105415801_FF |
| 115 | C | 209638925 | 209688639 | 209692638 | ORF116_2_209634852_209638927_209684451_209692640_FF |
| 116 | C | 8143221 | 8177380 | 8181379 | ORF172_9_8138555_8143223_8167171_8181381_FF |
| 117 | C | 106160952 | 106232487 | 106236486 | ORF13_2_106158642_106160954_106232485_106234911_FR |
| 118 | C | 42385917 | 42438801 | 42442800 | ORF128_5_42377041_42385919_42438799_42441730_FR |
| 119 | C | 27245700 | 27322521 | 27326520 | ORF12_16_27236516_27245702_27324505_27326522_FF |
| 120 | C | 111521188 | 111535222 | 111539221 | ORF186_1_111517187_111519912_111535220_111538688_RR |
| 12: | C | 8818992 | 8891562 | 8895561 | ORF102_9_8811961_8818994_8886566_8895563_FF |
| 122 | C | 155223096 | 155268263 | 155272262 | ORF194_6_155219095_155222285_155266642_155272264_RF |
| 123 | C | 38152630 | 38176977 | 38180976 | ORF153_2_38148629_38149203_38180978_RF |
| 124 | C | 174773895 | 174877546 | 174881545 | ORF176_2_174770802_174773897_174874107_174881547_FF |
| 125 | C | 27280528 | 27312086 | 27316085 | ORF12_13_27276527_27282043_27312084_27318228_RR |
| 126 | C | 111039040 | 111093154 | 111097153 | ORF16_7_111035039_111042953_111093152_111098806_RR |
| 127 | C | 106162643 | 106232487 | 106236486 | ORF14_2_106158642_106160954_106232485_106234911_RR |
| 128 | C | 110929889 | 110971829 | 110975828 | ORF193_7_110903831_110929891_110971827_110980437_FR |
| 129 | C | 176617478 | 176678881 | 176682880 | ORF1_5_176613477_176617551_176680676_176682882_RF |
| 130 | C | 106140912 | 106183994 | 106187993 | ORF18_7_106136911_106139119_106183992_106185753_RR |
| 131 | C | 8541376 | 8588022 | 8592021 | ORF142_20_8536736_8541378_8588020_8590421_FR |
| 132 | C | 20562242 | 20608047 | 20612046 | ORF175_4_20552692_20562244_20609595_20612048_FF |
| 133 | C | 21487559 | 21556004 | 21560003 | ORF130_20_21483562_21487561_21556998_21560005_FF |
| 134 | C | 10327988 | 10353510 | 10357509 | ORF13_20_10323987_10325423_10353508_10357454_RR |
| 135 | C | 22372713 | 22401548 | 22405547 | ORF12_7_22368712_22370568_22401546_22402661_RR |
| 136 | C | 79074483 | 79131600 | 79135599 | ORF192_5_79070482_79135599_79144935_RR |
| 137 | C | 229820594 | 229851717 | 229855716 | ORF145_1_229817736_229820596_229849427_229855718_FF |
| 138 | C | 61652547 | 61711999 | 61715998 | ORF162_6_61648546_61654260_61702551_61716000_RF |
| 139 | B | 44530702 | 44601772 | 44605771 | ORF194_11_44526701_44529279_44604674_44605773_RP |
| 140 | B | 46488237 | 46559201 | 46563200 | ORF16_3_46479747_46488239_46559199_46566649_FR |
| 141 | B | 209618912 | 209688639 | 209692638 | ORF184_2_209614911_209618135_209684451_209692640_RF |
| 142 | B | 106140912 | 106190438 | 106194437 | ORF13_7_106136911_106139119_106190436_106195694_RR |
| 143 | B | 111476533 | 111535222 | 111539221 | ORF155_1_111472532_111477653_111535220_111538688_RR |
| 144 | B | 68653665 | 68704466 | 68708465 | ORF128_6_68648483_68653667_68703842_68708467_FF |
| 145 | B | 88356400 | 88399415 | 88403414 | ORF127_15_88349285_88356402_88403414_88400169_88403416_FF |
| 146 | B | 176617478 | 176664726 | 176668725 | ORF11_5_176613477_176617551_176666420_176668727_RF |
| 147 | B | 100327803 | 100399167 | 100403166 | ORF193_14_100323802_100329446_100399165_100403839_RR |
| 148 | B | 1990445 | 2093495 | 2097494 | ORF11_17_1986444_1988214_2093493_2096428_RR |
| 149 | B | 151965422 | 152012396 | 152016395 | ORF18_4_151954708_151965424_152011202_152016397_FF |
| 150 | B | 124409372 | 124446459 | 124450458 | ORF199_5_124405371_124409805_124446457_124450050_RR |
| 151 | B | 120070946 | 120086308 | 120090307 | ORF108_11_120066945_120072959_120088100_120090309_RF |
| 152 | B | 106140912 | 106195696 | 106199695 | ORF16_7_106136911_106139119_106195694_106199610_RR |
| 153 | B | 163985775 | 164038167 | 164042166 | ORF1_6_163982666_163985777_164038165_164043521_FR |

TABLE 8.3h

| No | Group | PCR-Primer1_ID | PCR_Primer1 | PCR-Primer2_ID | PCR_Primer2 |
|---|---|---|---|---|---|
| 103 | C | OBD159_3305 | AAGAGCACGGACACCAAACAGGTCTA (SEQ ID NO: 3959) | OBD159_3307 | CTCAGCCTTAGGAGGATGTGACTATC (SEQ ID NO: 4010) |
| 104 | C | OBD159_3277 | GCTGGCTTGGGATTGTGTTGAACCAC (SEQ ID NO: 3960) | OBD159_3279 | TTTTCTCAAACGAGTCCCACCCAATA (SEQ ID NO: 4011) |
| 105 | C | OBD159_3193 | ACTAAGAAGTCAGGGAAGGTAAGCCC (SEQ ID NO: 3961) | OBD159_3195 | CTAATACGAAAACCAAGGAATACCCT (SEQ ID NO: 4012) |
| 106 | C | OBD159_3261 | GCCCTGGATAGGACCTGGCAGAT (SEQ ID NO: 3962) | OBD159_3263 | CTGACTCTCTTGGGTGCTTGAGC (SEQ ID NO: 4013) |
| 107 | C | OBD159_3181 | CCTGAGTCCCCAAAGTCCATTAGTCC (SEQ ID NO: 3963) | OBD159_3183 | CTCATAGAAAAGGGTAGAAAGCAGAG (SEQ ID NO: 4014) |
| 108 | C | OBD159_3321 | TGTGTGTAAGTTCCCTTCCCCGACTA | OBD159_3323 | GAAGGACAAAGAGCAGATGGAACAAA |

TABLE 8.3h-continued

| No | Group | PCR-Primer1_ID | PCR_Primer1 | PCR-Primer2_ID | PCR_Primer2 |
|----|-------|----------------|-------------|----------------|-------------|
| | | | (SEQ ID NO: 3964) | | (SEQ ID NO: 4015) |
| 109 | C | OBD159_3349 | CCTCACACAGTCCTCTTCCCACC (SEQ ID NO: 1194) | OBD159_3351 | GAGTCAGCCTATGGGACACAGCA (SEQ ID NO: 4016) |
| 110 | C | OBD159_3169 | TAGAACCCATAGCACCAAGTCCAT (SEQ ID NO: 3966) | OBD159_3171 | GTGTCTTAGGCACATCATTCAGC (SEQ ID NO: 4017) |
| 111 | C | OBD159_3157 | TTTGGTGTATGGTGTAGTAACCTCAC (SEQ ID NO: 3967) | OBD159_3159 | CTCTACCATTTTCTGCTTCCTCCGCC (SEQ ID NO: 4018) |
| 112 | C | OBD159_3217 | CCTTCTTCTCCTTGCCTTTCCTCTGG (SEQ ID NO: 3968) | OBD159_3219 | GGAGTTCAACAAAGTGGTGGGAATCT (SEQ ID NO: 4019) |
| 113 | C | OBD159_3213 | CCAAATCCAGACAAGGACATTCAAGA (SEQ ID NO: 3969) | OBD159_3215 | CCCAGGAGCCCAGTTGAAGACCAT (SEQ ID NO: 4020) |
| 114 | C | OBD159_3361 | TCCTACCTTGGGAGTGAGTGAAAGAG (SEQ ID NO: 3970) | OBD159_3363 | GACACCTGCTGGTTGAGAGTGACAAT (SEQ ID NO: 4021) |
| 115 | C | OBD159_3189 | GTGTAAGCAGTTTATGGTCAGAGTCT (SEQ ID NO: 3971) | OBD159_3191 | GCTTATTTCCTGAACGCACTTGCCTA (SEQ ID NO: 2412) |
| 116 | C | OBD159_3221 | TTTACAGCCCCACCAGCAACACAGGA (SEQ ID NO: 3816) | OBD159_3223 | GAGAGAAGTGAGAGAAAGTTGGGACT (SEQ ID NO: 4023) |
| 117 | C | OBD159_3289 | GCAGTGACGGGCATAAGATGGAC (SEQ ID NO: 3973) | OBD159_3291 | TGTGCTCTCCCTCCCCAATGTGC (SEQ ID NO: 4024) |
| 118 | C | OBD159_3165 | TTGGCAAAACAACTTCCCACTGACCT (SEQ ID NO: 3974) | OBD159_3167 | GGTGGCTCTGGCTGATGGTCTTTCAT (SEQ ID NO: 4025) |
| 119 | C | OBD159_3333 | GCCAGCAAGAGCCAGAGACACAA (SEQ ID NO: 3975) | OBD159_3335 | TGAGGAGATGGCTGGACACGGCA (SEQ ID NO: 4026) |
| 120 | C | OBD159_3373 | GTCACCCTGTATTGCCATAGCAGCAT (SEQ ID NO: 3976) | OBD159_3375 | GGCTCTGAACCTCTCCTTGGAACAAT (SEQ ID NO: 4027) |
| 121 | C | OBD159_3205 | AACTAACCAGGAAAACGACATAGCAC (SEQ ID NO: 1238) | OBD159_3207 | CCTTCCAAGAGGGTCTGGCATTCTC (SEQ ID NO: 4028) |
| 122 | C | OBD159_3285 | GTGAAGGCTACTGACAAAAGGTATGG (SEQ ID NO: 3978) | OBD159_3287 | CAGCCTACTCCTGCTAAAGGGAAAGG (SEQ ID NO: 4029) |
| 123 | C | OBD159_3397 | CTCTATTTGGCATCCTTTCCTTAGGC (SEQ ID NO: 3979) | OBD159_3399 | GGCAGAAATGTAAGGAGCACACCTGG (SEQ ID NO: 4030) |
| 124 | C | OBD159_3209 | AATGTCTATCTCAGCAGAGTCACAGA (SEQ ID NO: 3980) | OBD159_3211 | CTACCCCAGATGGCTGTGAGGATTAC (SEQ ID NO: 4031) |
| 125 | C | OBD159_3317 | TTAGAACTTCCATTGTGCCCTTCGCC (SEQ ID NO: 3981) | OBD159_3319 | GGAGTTATGGGAAGAGGAAGGGATGA (SEQ ID NO: 4032) |
| 126 | C | OBD159_3173 | AGCAGTTACAGTTTTGAAGCAGGGCT (SEQ ID NO: 3982) | OBD159_3175 | TGTGGCATTTGAGGCAGAGCGAGCAA (SEQ ID NO: 4033) |
| 127 | C | OBD159_3377 | ACCTCTGTTTGAGTGACCCTGGG (SEQ ID NO: 3983) | OBD159_3379 | TGTGCTCTCCCTCCCCAATGTGC (SEQ ID NO: 4024) |
| 128 | C | OBD159_3225 | GAAGTGACAGAGAAGGTGCCATTTAC (SEQ ID NO: 3984) | OBD159_3227 | CCTCTCCCCACACATACACCTAACTC (SEQ ID NO: 4035) |
| 129 | C | OBD159_3453 | AGCGAGGTCAATAACACCCAGGG (SEQ ID NO: 3985) | OBD159_3455 | CGGTGCTGGGCTTGCCATAACAC (SEQ ID NO: 4036) |
| 130 | C | OBD159_3293 | AAGAGCACGGACACCAAACAGGTCTA (SEQ ID NO: 3959) | OBD159_3295 | TGGAGTCACTTGTGTCAAAACCCTGA (SEQ ID NO: 4037) |
| 131 | C | OBD159_3281 | GCTGGTGTGCCACTAATGCTCTCC (SEQ ID NO: 3987) | OBD159_3283 | TTCATCTTCCCACCTCCCCTGGA (SEQ ID NO: 4038) |
| 132 | C | OBD159_3249 | TCATCTCCACCCCTCCACTGAAACTA (SEQ ID NO: 3988) | OBD159_3251 | GTAGTCCCTGAAGAGCAATCTCAAGG (SEQ ID NO: 4039) |
| 133 | C | OBD159_3297 | AGAAGGCTGGGTGTCCAAGCAGG (SEQ ID NO: 3989) | OBD159_3299 | CCATCTTGAGACAGCACCTCTGG (SEQ ID NO: 4040) |

TABLE 8.3h-continued

| No | Group | PCR-Primer1_ID | PCR_Primer1 | PCR-Primer2_ID | PCR_Primer2 |
|---|---|---|---|---|---|
| 134 | C | OBD159_3253 | AGGTCCTTGACACTCTCCCTCCG (SEQ ID NO: 3990) | OBD159_3255 | TGGGCTTGTGTTCAGGCTCTGTG (SEQ ID NO: 4041) |
| 135 | C | OBD159_3345 | CGGAGACCACCATACAATAGTGCTGC (SEQ ID NO: 3991) | OBD159_3347 | CTTGAGAGAAGTCCATCTAATAGGGC (SEQ ID NO: 4042) |
| 136 | C | OBD159_3329 | TTCTGAATGACAGGGCTGGAGCGG (SEQ ID NO: 3992) | OBD159_3331 | AGTGGGTCACGAAACAGAAGAACTCT (SEQ ID NO: 4043) |
| 137 | C | OBD159_3273 | CCCCTCTTCTCCTGGGTTTATGGG (SEQ ID NO: 3993) | OBD159_3275 | GCTTTGCTTCACAGGCTTGCCCA (SEQ ID NO: 1434) |
| 138 | C | OBD159_3229 | GTAAGTCCTTCCTACTGTGCCTTTGG (SEQ ID NO: 3994) | OBD159_3231 | CAGGATGGTTAGAATGACCGCCTTGT (SEQ ID NO: 4045) |
| 139 | B | OBD159_3905 | GCCTCTATGTGCCTGTTCCACCA (SEQ ID NO: 3995) | OBD159_3907 | TTATTGCTCCCCACACCCCACCC (SEQ ID NO: 4046) |
| 140 | B | OBD159_3909 | CTCCAGGATTCATTCCAGCCTTCC (SEQ ID NO: 3996) | OBD159_3911 | AGTTACTGTGGCTGGCTGGGCTG (SEQ ID NO: 4047) |
| 141 | B | OBD159_3913 | GCTTATTTCCTGAACGCACTTGCCTA (SEQ ID NO: 2412) | OBD159_3915 | CACCAGAGAGAGGGAAATACAGGCTG (SEQ ID NO: 4048) |
| 142 | B | OBD159_3917 | GAGCACGGACACCAAACAGGTCT (SEQ ID NO: 3998) | OBD159_3919 | AACACAGTCCACCTGCCCCTCAG (SEQ ID NO: 4049) |
| 143 | B | OBD159_3921 | GTTCCTTGCCTCACAGACTCTACCAC (SEQ ID NO: 3999) | OBD159_3923 | GAAGTTAGCACAAAAGGAACCTGGAG (SEQ ID NO: 4050) |
| 144 | B | OBD159_3925 | GGAACAGTTGTGGTGTGCTAAAACG (SEQ ID NO: 4000) | OBD159_3927 | TGGACCCTGTGCCTCCCACTGTG (SEQ ID NO: 4051) |
| 145 | B | OBD159_3929 | GAGGAGCATTCTGGTTATCTATCACC (SEQ ID NO: 4001) | OBD159_3931 | GACTGCCTGTTTTCCAGCCATTTCCC (SEQ ID NO: 4052) |
| 146 | B | OBD159_3933 | GCTTCTTCCTCTGTCCCATAGCG (SEQ ID NO: 4002) | OBD159_3935 | CGGTGCTGGGCTTGCCATAACAC (SEQ ID NO: 4036) |
| 147 | B | OBD159_3937 | ATCAGTCTTTCACCAGGAGCCCTTCC (SEQ ID NO: 4003) | OBD159_3939 | AGTTACTGCCTCAAGACACACTCAAT (SEQ ID NO: 4054) |
| 148 | B | OBD159_3941 | TGGCTTCCCTCTGTCTCCTCCTC (SEQ ID NO: 4004) | OBD159_3943 | GCCTCTCAGACTGGCTTCCAAAC (SEQ ID NO: 4055) |
| 149 | B | OBD159_3945 | GGGAGATGAATGGGTGAGGCGAT (SEQ ID NO: 4005) | OBD159_3947 | GTGCTCTTGGTCTCCTCAGCCTC (SEQ ID NO: 4056) |
| 150 | B | OBD159_3949 | ATGGATAGATGGCAGAGGAACACAGC (SEQ ID NO: 4006) | OBD159_3951 | CAAGGAGGAGAAACAGGAGAAGGTAG (SEQ ID NO: 4057) |
| 151 | B | OBD159_3953 | GGATTCCCAGATTGAAAACAGTGCCA (SEQ ID NO: 4007) | OBD159_3955 | GCGAGAGAGAAGAGAGGCATCCACAT (SEQ ID NO: 2144) |
| 152 | B | OBD159_3957 | CTCTATGTCCTCCCCACAGCCTG (SEQ ID NO: 4008) | OBD159_3959 | TTTCAGCCAAGGGTCAAGGTGGG (SEQ ID NO: 4059) |
| 153 | B | OBD159_3961 | GGAGGGAGAAAGTCAGGAGAGAG (SEQ ID NO: 4009) | OBD159_3963 | CTGCCTGCCCATAGTCACCAGCA (SEQ ID NO: 4060) |

55

TABLE 8.4a

| No. | Group | Probe | GeneLocus | Probe_Count_Total |
|---|---|---|---|---|
| 154 | B | ORF137_6_27448356_27449458_27496333_27502209_RF | N/A | N/A |
| 155 | B | ORF18_2_199605749_199608546_199669603_199675100_RR | N/A | N/A |
| 156 | B | ORF197_20_59641481_59643132_59702033_59707786_RR | N/A | N/A |
| 157 | B | ORF190_6_139979966_139988144_140005899_140012028_RF | N/A | N/A |
| 158 | B | ORF17_7_22293458_22299215_22368712_22370568_FF | N/A | N/A |
| 159 | B | ORF11_7_106136911_106139119_106205835_106208610_RR | N/A | N/A |

TABLE 8.4a-continued

| No. | Group | Probe | GeneLocus | Probe_Count_Total |
|-----|-------|-------|-----------|-------------------|
| 160 | B | ORF12_20_38255838_38257757_38271295_38273280_RF | N/A | N/A |
| 161 | B | ORF170_9_8138555_8143223_8162352_8167171_FF | N/A | N/A |
| 162 | B | ORF157_10_12567857_12569357_12596194_12598368_FR | N/A | N/A |
| 163 | B | ORF14_6_114033384_114036052_114107829_114113558_RF | N/A | N/A |
| 164 | B | ORF11_18_21178112_21180915_21194021_21196235_RR | N/A | N/A |
| 165 | B | ORF169_X_922098_928065_989932_992112_FF | N/A | N/A |
| 166 | B | ORF147_6_146088385_146093865_146155392_146161780_FR | N/A | N/A |
| 167 | B | ORF179_9_92586435_92592480_92667358_92668932_FR | N/A | N/A |
| 168 | D | ORF148_1_229796281_229797522_229849427_229855718_FF | N/A | N/A |
| 169 | D | ORF121_3_182183246_182185848_182234332_182242013_FR | N/A | N/A |
| 170 | D | ORF166_7_29763050_29768509_29809501_29813015_RR | N/A | N/A |
| 171 | D | ORF18_6_137232223_137235679_137341897_137343885_RF | N/A | N/A |
| 172 | D | ORF147_21_30947497_30949256_30984126_30988102_RF | N/A | N/A |
| 173 | D | ORF197_4_22994756_23003981_23065929_23067873_FR | N/A | N/A |
| 174 | D | ORF115_9_28293258_28294446_28333777_28339631_FF | N/A | N/A |
| 175 | D | ORF17_4_105415477_105417649_105457783_105460154_FF | N/A | N/A |
| 176 | D | ORF125_9_28270698_28275294_28333777_28339631_RF | N/A | N/A |
| 177 | D | ORF162_6_46989661_46997140_47060758_47069708_RF | N/A | N/A |
| 178 | D | ORF103_18_58202022_58205094_58215328_58217936_RF | N/A | N/A |
| 179 | D | ORF167_2_195495210_195503375_195555062_195566669_FF | N/A | N/A |
| 180 | D | ORF118_18_11071108_11073538_11120542_11126658_RF | N/A | N/A |
| 181 | D | ORF1_16_68414192_68421728_68462182_68469147_RF | N/A | N/A |
| 182 | D | ORF16_2_39607186_39609982_39623225_39627003_FR | N/A | N/A |
| 183 | D | ORF144_2_227875567_227878014_227923203_227932124_RF | N/A | N/A |

25

TABLE 8.4b

| No. | Group | Probe_Count_Sig | HyperG_Stats | FDR_HyperG | Percent_Sig | logFC | AveExpr |
|-----|-------|-----------------|--------------|------------|-------------|-------|---------|
| 154 | B | N/A | N/A | N/A | N/A | −0.574808854 | −0.574808854 |
| 155 | B | N/A | N/A | N/A | N/A | −0.574456379 | −0.574456379 |
| 156 | B | N/A | N/A | N/A | N/A | −0.574072863 | −0.574072863 |
| 157 | B | N/A | N/A | N/A | N/A | −0.573424876 | −0.573424876 |
| 158 | B | N/A | N/A | N/A | N/A | −0.572722674 | −0.572722674 |
| 159 | B | N/A | N/A | N/A | N/A | −0.57025385 | −0.57025385 |
| 160 | B | N/A | N/A | N/A | N/A | −0.570159448 | −0.570159448 |
| 161 | B | N/A | N/A | N/A | N/A | −0.569614568 | −0.569614568 |
| 162 | B | N/A | N/A | N/A | N/A | −0.568586595 | −0.568586595 |
| 163 | B | N/A | N/A | N/A | N/A | −0.568433457 | −0.568433457 |
| 164 | B | N/A | N/A | N/A | N/A | −0.566875906 | −0.566875906 |
| 165 | B | N/A | N/A | N/A | N/A | −0.566118538 | −0.566118538 |
| 166 | B | N/A | N/A | N/A | N/A | −0.565782344 | −0.565782344 |
| 167 | B | N/A | N/A | N/A | N/A | −0.565725741 | −0.565725741 |
| 168 | D | N/A | N/A | N/A | N/A | −0.964755594 | −0.964755594 |
| 169 | D | N/A | N/A | N/A | N/A | −0.909959217 | −0.909959217 |
| 170 | D | N/A | N/A | N/A | N/A | −0.877638416 | −0.877638416 |
| 171 | D | N/A | N/A | N/A | N/A | −0.810473195 | −0.810473195 |
| 172 | D | N/A | N/A | N/A | N/A | −0.808156687 | −0.808156687 |
| 173 | D | N/A | N/A | N/A | N/A | −0.778465363 | −0.778465363 |
| 174 | D | N/A | N/A | N/A | N/A | −0.758831154 | −0.758831154 |
| 175 | D | N/A | N/A | N/A | N/A | −0.756728555 | −0.756728555 |
| 176 | D | N/A | N/A | N/A | N/A | −0.754448335 | −0.754448335 |
| 177 | D | N/A | N/A | N/A | N/A | −0.75272274 | −0.75272274 |
| 178 | D | N/A | N/A | N/A | N/A | −0.731354707 | −0.731354707 |
| 179 | D | N/A | N/A | N/A | N/A | −0.72169935 | −0.72169935 |
| 180 | D | N/A | N/A | N/A | N/A | −0.713531849 | −0.713531849 |
| 181 | D | N/A | N/A | N/A | N/A | −0.709015088 | −0.709015088 |
| 182 | D | N/A | N/A | N/A | N/A | −0.707334239 | −0.707334239 |
| 183 | D | N/A | N/A | N/A | N/A | −0.707018011 | −0.707018011 |

TABLE 8.4c

| No. | Group | t | P. Value | adj. P. Val | B | FC |
|-----|-------|---|----------|-------------|---|-----|
| 154 | B | −6.891641208 | 0.0000168 | 0.000246158 | 3.098736098 | 0.671375197 |
| 155 | B | −2.611844439 | 0.02274847 | 0.049819113 | −4.243494208 | 0.671539246 |
| 156 | B | −4.61133913 | 0.000601458 | 0.003065125 | −0.591631572 | 0.671717787 |

TABLE 8.4c-continued

| No. | Group | t | P. Value | adj. P. Val | B | FC |
|---|---|---|---|---|---|---|
| 157 | B | −9.334337757 | 0.000000759 | 0.0000339 | 6.287070231 | 0.672019557 |
| 158 | B | −6.381551033 | 0.0000352 | 0.000400231 | 2.336127221 | 0.672346728 |
| 159 | B | −3.595523531 | 0.003684558 | 0.011925472 | −2.438232364 | 0.673498272 |
| 160 | B | −8.7739789 | 0.00000146 | 0.0000508 | 5.61810193 | 0.673542344 |
| 161 | B | −11.58873382 | 0.0000000723 | 0.00000818 | 8.666630667 | 0.673796777 |
| 162 | B | −5.179850602 | 0.00023053 | 0.001508329 | 0.395056271 | 0.674277053 |
| 163 | B | −10.4552549 | 0.000000224 | 0.0000160 | 7.528399343 | 0.674348629 |
| 164 | B | −15.82649224 | 0.00000000214 | 0.00000133 | 12.11208444 | 0.675077057 |
| 165 | B | −4.881942371 | 0.000378953 | 0.002172424 | −0.116892175 | 0.675431543 |
| 166 | B | −5.666896334 | 0.000105058 | 0.000857 | 1.206210626 | 0.675588959 |
| 167 | B | −17.95302616 | 0.000000000501 | 0.000000711 | 13.4756476 | 0.675615466 |
| 168 | D | −3.798122869 | 0.00254516 | 0.008973828 | −2.064090726 | 0.512365204 |
| 169 | D | −4.467590389 | 0.000771749 | 0.003675953 | −0.847309931 | 0.532200136 |
| 170 | D | −7.390325566 | 0.00000846 | 0.000155288 | 3.809994153 | 0.544257612 |
| 171 | D | −14.01750686 | 0.0000000000857 | 0.00000267 | 10.77710333 | 0.570194807 |
| 172 | D | −7.948752109 | 0.00000405 | 0.0000965 | 4.567931437 | 0.571111093 |
| 173 | D | −7.815132055 | 0.00000482 | 0.000108145 | 4.39016783 | 0.582986603 |
| 174 | D | −8.336490328 | 0.00000249 | 0.0000707 | 5.071383935 | 0.590974934 |
| 175 | D | −12.5874418 | 0.0000000288 | 0.00000502 | 9.584177076 | 0.591836855 |
| 176 | D | −5.670620457 | 0.000104442 | 0.000853663 | 1.212285842 | 0.59277301 |
| 177 | D | −8.225011167 | 0.00000286 | 0.0000771 | 4.928493509 | 0.593482445 |
| 178 | D | −5.316223813 | 0.000184376 | 0.001280565 | 0.625473386 | 0.602338046 |
| 179 | D | −10.8736462 | 0.00000146 | 0.0000123 | 7.961387425 | 0.606382763 |
| 180 | D | −5.161266549 | 0.000237704 | 0.001542225 | 0.363462055 | 0.609825402 |
| 181 | D | −6.967290763 | 0.0000151 | 0.000229077 | 3.208783547 | 0.611737623 |
| 182 | D | −6.714567946 | 0.0000217 | 0.000290609 | 2.838087003 | 0.612450759 |
| 183 | D | −4.350938497 | 0.000946609 | 0.004268251 | −1.056437739 | 0.612585018 |

TABLE 8.4d

| No. | Group | FC_1 | LS | Loop Detected |
|---|---|---|---|---|
| 154 | B | −1.489480106 | −1 | Severe Autism |
| 155 | B | −1.489116245 | −1 | Severe Autism |
| 156 | B | −1.48872044 | −1 | Severe Autism |
| 157 | B | −1.488051932 | −1 | Severe Autism |
| 158 | B | −1.487327829 | −1 | Severe Autism |
| 159 | B | −1.484784804 | −1 | Severe Autism |
| 160 | B | −1.484687651 | −1 | Severe Autism |
| 161 | B | −1.484127017 | −1 | Severe Autism |
| 162 | B | −1.483069899 | −1 | Severe Autism |
| 163 | B | −1.482912483 | −1 | Severe Autism |
| 164 | B | −1.481312377 | −1 | Severe Autism |
| 165 | B | −1.480534941 | −1 | Severe Autism |
| 166 | B | −1.480189969 | −1 | Severe Autism |
| 167 | B | −1.480131896 | −1 | Severe Autism |
| 168 | D | −1.951732852 | −1 | Severe Autism |
| 169 | D | −1.878992381 | −1 | Severe Autism |
| 170 | D | −1.837365209 | −1 | Severe Autism |
| 171 | D | −1.753786579 | −1 | Severe Autism |
| 172 | D | −1.750972817 | −1 | Severe Autism |
| 173 | D | −1.715305282 | −1 | Severe Autism |
| 174 | D | −1.692119144 | −1 | Severe Autism |
| 175 | D | −1.689654828 | −1 | Severe Autism |
| 176 | D | −1.686986391 | −1 | Severe Autism |
| 177 | D | −1.684969807 | −1 | Severe Autism |
| 178 | D | −1.660197304 | −1 | Severe Autism |
| 179 | D | −1.649123393 | −1 | Severe Autism |
| 180 | D | −1.63981362 | −1 | Severe Autism |
| 181 | D | −1.634687753 | −1 | Severe Autism |
| 182 | D | −1.632784327 | −1 | Severe Autism |
| 183 | D | −1.632426472 | −1 | Severe Autism |

TABLE 8.4e

| No | Group | Probe sequence 60 mer | Probe Location Chr |
|----|-------|----------------------|--------------------|
| 154 | B | ATGACAAATGTAAAGAATACAAAAGTAATCGATCTTACCTGGACTACTAGCATTCCAACT (SEQ ID NO: 4061) | 6 |
| 155 | B | TGCTTCTTTTTTTTCTGAGGCCAAATCTCGAGTCCATGTGTTTCTGATTCGTTTTTATT (SEQ ID NO: 4062) | 2 |
| 156 | B | AATAAGAAAGAATTCTCTCTATCTGTCTTCGATAGCTCATTTCTTTTTATTGTTGCTTAA (SEQ ID NO: 4063) | 20 |
| 157 | B | TAAACTTTTAAAGAAAGCAAGAATTGCATCGAAGTTTACGTTAGGCCTCTCTCTTAGGTT (SEQ ID NO: 4064) | 6 |
| 158 | B | TCTTTCCTAATATAAGCATTAAAATCTATCGATGATTAAACCAGAAAGGAAAACAAAAGA (SEQ ID NO: 4065) | 7 |
| 159 | B | CTCACCACCTCCTAGCTATGACCCTTGGTCGAGAGGCAAGAAATGCTTCAACCGTGCAAT (SEQ ID NO: 4066) | 7 |
| 160 | B | GTCTTCTTTGTGTGGAGGAAGCAGTTTCTCGACCCCCTGCCCCTCACTGAGCCTTAGTTT (SEQ ID NO: 4067) | 20 |
| 161 | B | CCCCACTCTGCCCTCAATTGTGGTTCATTCGAACTTTCTTCTAAAAAGCCTAAAATACTT (SEQ ID NO: 4068) | 9 |
| 162 | B | TACATTGATTACAGAAAATCTTGTTATTTCGACAAAATAAATGTAGTAGAATTTCTTTGA (SEQ ID NO: 4069) | 10 |
| 163 | B | GCTGCCTTCTTTCCATTGATGTTTCAATTCGAGACTCCTTCTCAAAAACAAAAACAACCA (SEQ ID NO: 4070) | 6 |
| 164 | B | ACACTGCCTCCTCTCTTTGTCCCTCTAGTCGAACTATTTTGCAACTTTAGCTCCTATCCT (SEQ ID NO: 4071) | 18 |
| 165 | B | ATCTATCCATTATCTATCTACCTATTTCTCGATTTAAAAAAAATAAAAATAAATAAATAA (SEQ ID NO: 4072) | X |
| 166 | B | ATTAGAATATTATCCTCACATTTCTAGGTCGATATACCATAGGTGTATAGTAGGTTATGC (SEQ ID NO: 4073) | 6 |
| 167 | B | ATTACAATTTTTGATCACACTGTAATTTTCGAACTCAACAGGTCCTAAAAAGCTGCCTTC (SEQ ID NO: 4074) | 9 |
| 168 | D | CTTAATCAATTGGAGTTTAACCTTTGGTTCGATTTTTCAATGTTTGTGACAAAACCGGTT (SEQ ID NO: 1158) | 1 |
| 169 | D | ACACCCATTTTTAGGAATATTACAGTTGTCGATTGTATTTTGACAGGAAAGCAGAATGTA (SEQ ID NO: 1117) | 3 |
| 170 | D | ACCATATGGTGACTTTATCTTTACTCCTTCGAGGGGAACTATTAAATATGAGTTAGGGTT (SEQ ID NO: 1356) | 7 |
| 171 | D | TGTTTATCTCAAAAGAAGCTCAGAAAACTCGATTTTTAAGAGTCAAAGATTTTGATTTAA (SEQ ID NO: 1383) | 6 |
| 172 | D | AATGAAACTGTAAGTTTCCCCAATTAAATCGAATCCGTAAATTCTAACACCTCCCTTCTT (SEQ ID NO: 1157) | 21 |
| 173 | D | GTAAAAACAAAGCAAATTCTTCAAAATTTCGAATGAATAAAAAATTCATAAAAATAAGGC (SEQ ID NO: 1408) | 4 |
| 174 | D | CAGAAAATTCAAATAAACTGTTAAAATTTCGATAGATCCTAATATTACTATTTAGTGGGC (SEQ ID NO: 1110) | 9 |
| 175 | D | AATTCCATCTCAATTATAATTTTTTAACTCGATCTGCGATTGTTTGAATCTGCAGATGCA (SEQ ID NO: 1365) | 4 |
| 176 | D | GCCCACTAAATAGTAATATTAGGATCTATCGAATTTGTGCTTGTTGGGAAAATAGTAATT (SEQ ID NO: 1122) | 9 |
| 177 | D | TTGGAAAAGGTAAATTGTGTTTTGTAAATCGAACATCAGGTCAGAATTCCAAAGGGGCGT (SEQ ID NO: 1354) | 6 |
| 178 | D | CGTAATGTTATTTTTAAAAACGTACTTTTCGAGGCATTCCAATAAAAATAAGTAAATTCT (SEQ ID NO: 1096) | 18 |
| 179 | D | AGACTGGATCCGTCACTTTAGAACAGACTCGAGATTATCAGTAAGCTCTAGGGAAACTAG (SEQ ID NO: 1358) | 2 |

TABLE 8.4e-continued

| No | Group | Probe sequence 60 mer | Probe Location Chr |
|---|---|---|---|
| 180 | D | ATATTTTTTTTTTTTTGTATTCCCAGAATCGAAAAGAAGTTCTTTTTATCCCAAAGGAGT (SEQ ID NO: 1112) | 18 |
| 181 | D | AAACTCAATGATAGAATTATTAAGGATTTCGACATTTTAAAAGGGCACTTGGAATTTCAC (SEQ ID NO: 1082) | 16 |
| 182 | D | TCTTTTCTGTGGTTAAATTTTATAAGGATCGATTCAGCTGGGGAAAAATGAAAATAACAA (SEQ ID NO: 1345) | 2 |
| 183 | D | TCTATATAAGAAATTCGTAGGATGAATATCGAATAATCTACCCATGGACATTTGTATCAC (SEQ ID NO: 1154) | 2 |

TABLE 8.4f

| | | Probe Location | | | | 4 kb Sequence Location | |
|---|---|---|---|---|---|---|---|
| No. | Group | Start1 | End1 | Start2 | End2 | Chr | Start1 |
| 154 | B | 27448358 | 27448387 | 27502178 | 27502207 | 6 | 27448358 |
| 155 | B | 199605751 | 199605780 | 199669605 | 199669634 | 2 | 199605751 |
| 156 | B | 59641483 | 59641512 | 59702035 | 59702064 | 20 | 59641483 |
| 157 | B | 139979968 | 139979997 | 140011997 | 140012026 | 6 | 139979968 |
| 158 | B | 22299184 | 22299213 | 22370537 | 22370566 | 7 | 22295214 |
| 159 | B | 106136913 | 106136942 | 106205837 | 106205866 | 7 | 106136913 |
| 160 | B | 38255840 | 38255869 | 38273249 | 38273278 | 20 | 38255840 |
| 161 | B | 8143192 | 8143221 | 8167140 | 8167169 | 9 | 8139222 |
| 162 | B | 12569326 | 12569355 | 12596196 | 12596225 | 10 | 12565356 |
| 163 | B | 114033386 | 114033415 | 114113527 | 114113556 | 6 | 114033386 |
| 164 | B | 21178114 | 21178143 | 21194023 | 21194052 | 18 | 21178114 |
| 165 | B | 928034 | 928063 | 992081 | 992110 | X | 924064 |
| 166 | B | 146093834 | 146093863 | 146155394 | 146155423 | 6 | 146089864 |
| 167 | B | 92592449 | 92592478 | 92667360 | 92667389 | 9 | 92588479 |
| 168 | D | 229797491 | 229797520 | 229855687 | 229855716 | 1 | 229793521 |
| 169 | D | 182185817 | 182185846 | 182234334 | 182234363 | 3 | 182181847 |
| 170 | D | 29763052 | 29763081 | 29809503 | 29809532 | 7 | 29763052 |
| 171 | D | 137232225 | 137232254 | 137343854 | 137343883 | 6 | 137232225 |
| 172 | D | 30947499 | 30947528 | 30988071 | 30988100 | 21 | 30947499 |
| 173 | D | 23003950 | 23003979 | 23065931 | 23065960 | 4 | 22999980 |
| 174 | D | 28294415 | 28294444 | 28339600 | 28339629 | 9 | 28290445 |
| 175 | D | 105417618 | 105417647 | 105460123 | 105460152 | 4 | 105413648 |
| 176 | D | 28270700 | 28270729 | 28339600 | 28339629 | 9 | 28270700 |
| 177 | D | 46989663 | 46989692 | 47069677 | 47069706 | 6 | 46989663 |
| 178 | D | 58202024 | 58202053 | 58217905 | 58217934 | 18 | 58202024 |
| 179 | D | 195503344 | 195503373 | 195566638 | 195566667 | 2 | 195499374 |
| 180 | D | 11071110 | 11071139 | 11126627 | 11126656 | 18 | 11071110 |
| 181 | D | 68414194 | 68414223 | 68469116 | 68469145 | 16 | 68414194 |
| 182 | D | 39609951 | 39609980 | 39623227 | 39623256 | 2 | 39605981 |
| 183 | D | 227875569 | 227875598 | 227932093 | 227932122 | 2 | 227875569 |

50

TABLE 8.4g

| | | 4 kb Sequence Location | | | |
|---|---|---|---|---|---|
| No. | Group | End1 | Start2 | End2 | Probe |
| 154 | B | 27452357 | 27498208 | 27502207 | ORF137_6_27448356_27449458_27496333_27502209_RF |
| 155 | B | 199609750 | 199669605 | 199673604 | ORF18_2_199605749_199608546_199669603_199675100_RR |
| 156 | B | 59645482 | 59702035 | 59706034 | ORF197_20_59641481_59643132_59702033_59707786_RR |
| 157 | B | 139983967 | 140008027 | 140012026 | ORF190_6_139979966_139988144_140005899_140012028_RF |
| 158 | B | 22299213 | 22366567 | 22370566 | ORF17_7_22293458_22299215_22368712_22370568_FF |
| 159 | B | 106140912 | 106205837 | 106209836 | ORF11_7_106136911_106139119_106205835_106208610_RR |
| 160 | B | 38259839 | 38269279 | 38273278 | ORF12_20_38255838_38257757_38271295_38273280_RF |
| 161 | B | 8143221 | 8163170 | 8167169 | ORF170_9_8138555_8143223_8162352_8167171_FF |
| 162 | B | 12569355 | 12596196 | 12600195 | ORF157_10_12567857_12569357_12596194_12598368_FR |

TABLE 8.4g-continued

| | | 4 kb Sequence Location | | |
| No. | Group | End1 | Start2 | End2 | Probe |
| --- | --- | --- | --- | --- | --- |
| 163 | B | 114037385 | 114109557 | 114113556 | ORF14_6_114033384_114036052_114107829_114113558_RF |
| 164 | B | 21182113 | 21194023 | 21198022 | ORF11_18_21178112_21180915_21194021_21196235_RR |
| 165 | B | 928063 | 988111 | 992110 | ORF169_X_922098_928065_989932_992112_FF |
| 166 | B | 146093863 | 146155394 | 146159393 | ORF147_6_146088385_146093865_146155392_146161780_FR |
| 167 | B | 92592478 | 92667360 | 92671359 | ORF179_9_92586435_92592480_92667358_92668932_FR |
| 168 | D | 229797520 | 229851717 | 229855716 | ORF148_1_229796281_229797522_229849427_229855718_FF |
| 169 | D | 182185846 | 182234334 | 182238333 | ORF121_3_182183246_182185848_182234332_182242013_FR |
| 170 | D | 29767051 | 29809503 | 29813502 | ORF166_7_29763050_29768509_29809501_29813015_RR |
| 171 | D | 137236224 | 137339884 | 137343883 | ORF18_6_137232223_137235679_137341897_137343885_RF |
| 172 | D | 30951498 | 30984101 | 30988100 | ORF147_21_30947497_30949256_30984126_30988102_RF |
| 173 | D | 23003979 | 23065931 | 23069930 | ORF197_4_22994756_23003981_23065929_23067873_FR |
| 174 | D | 28294444 | 28335630 | 28339629 | ORF115_9_28293258_28294446_28333777_28339631_FF |
| 175 | D | 105417647 | 105456153 | 105460152 | ORF17_4_105415477_105417649_105457783_105460154_FF |
| 176 | D | 28274699 | 28335630 | 28339629 | ORF125_9_28270698_28275294_28333777_28339631_RF |
| 177 | D | 46993662 | 47065707 | 47069706 | ORF162_6_46989661_46997140_47060758_47069708_RF |
| 178 | D | 58206023 | 58213935 | 58217934 | ORF103_18_58202022_58205094_58215328_58217936_RF |
| 179 | D | 195503373 | 195562668 | 195566667 | ORF167_2_195495210_195503375_195555062_195566669_FF |
| 180 | D | 11075109 | 11122657 | 11126656 | ORF118_18_11071108_11073538_11120542_11126658_RF |
| 181 | D | 68418193 | 68465146 | 68469145 | ORF1_16_68414192_68421728_68462182_68469147_RF |
| 182 | D | 39609980 | 39623227 | 39627226 | ORF16_2_39607186_39609982_39623225_39627003_FR |
| 183 | D | 227879568 | 227928123 | 227932122 | ORF144_2_227875567_227878014_227923203_227932124_RF |

25

30

35

40

45

50

55

60

65

TABLE 8.4h

| No. | PCR-GroupPrimer1_ID | PCR_Primer1 | PCR-Primer2_ID | PCR_Primer2 |
|---|---|---|---|---|
| 154 | B | OBD159_3965 GCTAAAAGAAGAAAACGATGAGGAGC (SEQ ID NO: 4091) | OBD159_3967 | GTCATTGGAGAGTGTCGGGCACAGAT (SEQ ID NO: 4121) |
| 155 | B | OBD159_3969 TTTTGTCTTCCTGCCCCTCTTCCTGC (SEQ ID NO: 4092) | OBD159_3971 | GGTTCGGCAGAATCTTTGGACATCAA (SEQ ID NO: 4122) |
| 156 | B | OBD159_3973 GGGACTGAATAGAGCAGGAAGACGGA (SEQ ID NO: 4093) | OBD159_3975 | GCACATCTGAATGACCTTCTAAGAGC (SEQ ID NO: 4123) |
| 157 | B | OBD159_3977 GGACAGATTGTGAGGCACCCTTGGAT (SEQ ID NO: 4094) | OBD159_3979 | CTCCCGACTTTCTTCAGGTTTGTAAC (SEQ ID NO: 4124) |
| 158 | B | OBD159_3981 CTTTCTGAGGTGGAAGCCCTGAT (SEQ ID NO: 4095) | OBD159_3983 | GCTTGAAAATCTCACTGTTGGTCCAC (SEQ ID NO: 4125) |
| 159 | B | OBD159_3985 AAGAGCACGGACACCAAACAGGTCTA (SEQ ID NO: 3959) | OBD159_3987 | GGAGCAAAGAAAGGAAACTGAAGCCC (SEQ ID NO: 4126) |
| 160 | B | OBD159_3989 GTGGAGGAGGTCAAGACTTCAGC (SEQ ID NO: 4097) | OBD159_3991 | GGAGATGGTGAGCCCAAGGCAGA (SEQ ID NO: 4127) |
| 161 | B | OBD159_3993 CACCAGCAACACAGGAGAGGACC (SEQ ID NO: 4098) | OBD159_3995 | GCCTTGTCTTGCCCTTGAGTCTC (SEQ ID NO: 4128) |
| 162 | B | OBD159_3997 CTGAGTCGGATGAACAGATGGTCTAC (SEQ ID NO: 4099) | OBD159_3999 | CTCTTCTGTTTGTGAGGGCTGCC (SEQ ID NO: 1564) |
| 163 | B | OBD159_4001 ATCTTCCTCTCCTTCAATGGATGGCT (SEQ ID NO: 4100) | OBD159_4003 | GCCCAAAGATTACATCCATTCTGGTA (SEQ ID NO: 4130) |
| 164 | B | OBD159_4005 ACAGTGGCTAAATCTCCTCCCTGGCT (SEQ ID NO: 4101) | OBD159_4007 | CAGAAGTTCCCTGTTGAGGTCTATCT (SEQ ID NO: 4131) |
| 165 | B | OBD159_4009 CTTCTATCTTCCATCTACCTGTCTAT (SEQ ID NO: 4102) | OBD159_4011 | GTTCAGGAGGTCTGGTTACAGTTCCA (SEQ ID NO: 4132) |
| 166 | B | OBD159_4013 AGGACTGCCAGGAACAAAGAGCCACT (SEQ ID NO: 4103) | OBD159_4015 | CTCTAAGTAAATCCTGGTCATTCCCC (SEQ ID NO: 1316) |
| 167 | B | OBD159_4017 TCCATTCATTCTCCAGCCCAGGG (SEQ ID NO: 4104) | OBD159_4019 | GGACCGAGGAGGAGAGAGAGCAA (SEQ ID NO: 4134) |
| 168 | D | OBD159_1009 CACAGCAACAAAAGCAACCTGGTGTC (SEQ ID NO: 1240) | OBD159_1011 | CCACCGATTTATTGCCCTGTAGGACA (SEQ ID NO: 1322) |
| 169 | D | OBD159_845 GAGACTGAGGTTGCTTCCAATGTTCC (SEQ ID NO: 1199) | OBD159_847 | TCCTCAGATGATGTTTCGGCATTTGC (SEQ ID NO: 1281) |
| 170 | D | OBD159_1145 GAAGAGACCTTATCCTTTTGAACTAC (SEQ ID NO: 1438) | OBD159_1147 | GAGTTTCAAGTGCCCTACTGGCTGA (SEQ ID NO: 1520) |
| 171 | D | OBD159_1253 GGAAATGGTGGCGGGAAGGAGAAATG (SEQ ID NO: 1465) | OBD159_1255 | TCATCATCGTGGACAAGGAAAGCCTA (SEQ ID NO: 1547) |
| 172 | D | OBD159_1005 GCATTCCAGGTCCAAGATGTCCT (SEQ ID NO: 1239) | OBD159_1007 | GTGGTGTGAGTTCAGGAGGGTTTAGG (SEQ ID NO: 1321) |
| 173 | D | OBD159_1353 GGAACTACAGTGTCTTCTACAGGGAC (SEQ ID NO: 1490) | OBD159_1355 | TTCAACTGGTAAGACATTCTGAGGAA (SEQ ID NO: 1572) |
| 174 | D | OBD159_817 GACATAGAATAATCTCCATCCATTGC (SEQ ID NO: 1192) | OBD159_819 | CTAAGTCCAGTAGTATGGTGGCTGTG (SEQ ID NO: 1274) |
| 175 | D | OBD159_1181 TGAGAGGTTATGACTTTTCCGAGGTC (SEQ ID NO: 1447) | OBD159_1183 | GAAGACATACACAGTAAGCCCTCTGC (SEQ ID NO: 1529) |
| 176 | D | OBD159_865 GCCTAAGTCCAGTAGTATGGTGGCTG (SEQ ID NO: 1204) | OBD159_867 | CAAGTCCTCATCTGTAGAGTCTGGAT (SEQ ID NO: 1286) |
| 177 | D | OBD159_1137 GGTTGCTGGCTGGAGTCTTCTGA (SEQ ID NO: 1436) | OBD159_1139 | CCAACCAAATGGGAGGCAACGCC (SEQ ID NO: 1518) |
| 178 | D | OBD159_761 TGTAGAGCCAAATAGCCACAGGGATA (SEQ ID NO: 966) | OBD159_763 | TTGAGGCAGGAAGAAAGGTTTATGGC (SEQ ID NO: 1260) |
| 179 | D | OBD159_1153 ACTCTGGCTCCGTTTCTTCCCTGACT (SEQ ID NO: 1440) | OBD159_1155 | AATACTGGCAAGAACCCATCTACTGC (SEQ ID NO: 1522) |

TABLE 8.4h-continued

| No. | PCR-GroupPrimer1_ID | PCR_Primer1 | PCR-Primer2_ID | PCR_Primer2 |
|---|---|---|---|---|
| 180 | D OBD159_825 | CCTCACACAGTCCTCTTCCCACC (SEQ ID NO: 1194) | OBD159_827 | GCCTGTCACTCCAATCTGTGGTG (SEQ ID NO: 1276) |
| 181 | D OBD159_705 | TGGAGAGGTGGAGGGAGGTAGGA (SEQ ID NO: 1164) | OBD159_707 | TGTCCTCCCTTCTCTTGCTCAGC (SEQ ID NO: 1246) |
| 182 | D OBD159_1101 | GCTTAGATGTGGCTTTGTCTTTTCTC (SEQ ID NO: 1427) | OBD159_1103 | GACCTGGCTACTCTTGAAACACCCAC (SEQ ID NO: 1509) |
| 183 | D OBD159_993 | CTTCTTCTCCTTGCCTTTCCTCTGGA (SEQ ID NO: 1236) | OBD159_995 | GGAGAAAAGACAAACCAGGGAAAGG G (SEQ ID NO: 1318) |

TABLE 9.1a

| No. | Group | Probe | GeneLocus | Probe_Count_Total |
|---|---|---|---|---|
| 1 | B | ORF1_X_140889640_140892387_140922520_140927482_FF | N/A | N/A |
| 2 | A | ORF13_12_10157054_10158072_10186674_10187896_FR | N/A | N/A |
| 3 | A | ORF150_2_156262877_156267602_156333728_156335220_FR | N/A | N/A |
| 4 | A | ORF191_3_168579832_168593354_168619477_168632678_RF | N/A | N/A |
| 5 | A | ORF101_2_20454246_20457908_20490253_20493006_FR | N/A | N/A |
| 6 | A | ORF107_7_38594689_38595956_38633652_38638705_RR | N/A | N/A |
| 7 | A | ORF16_22_25661627_25666380_25694410_25695479_RF | N/A | N/A |
| 8 | B | ORF18_1_230002404_230003670_230047264_230050830_RF | N/A | N/A |
| 9 | A | ORF106_X_39224581_39226649_39303922_39309694_RF | N/A | N/A |
| 10 | A | ORF143_6_146066540_146070987_146155392_146161780_FR | N/A | N/A |
| 11 | A | ORF161_7_112014904_112016980_112124185_112133295_RR | N/A | N/A |
| 12 | A | ORF141_1_77409324_77410804_77425166_77437348_FR | N/A | N/A |
| 13 | A | ORF152_12_82605920_82610130_82624217_82631901_FR | N/A | N/A |
| 14 | A | ORF163_3_177780034_177784103_177831413_177834825_FF | N/A | N/A |
| 15 | A | ORF1_7_107580951_107585747_107694264_107700145_RF | N/A | N/A |
| 16 | B | ORF194_9_106279286_106287735_106321634_106324034_RF | N/A | N/A |
| 17 | B | ORF186_3_69167897_69172562_69214794_69217124_FF | N/A | N/A |
| 18 | B | ORF196_16_68696944_68698250_68761044_68765212_RF | N/A | N/A |
| 19 | B | ORF14_3_57937518_57938971_57949710_57950765_FF | N/A | N/A |
| 20 | B | ORF102_10_112480267_112482497_112548771_112554911_FF | N/A | N/A |
| 21 | B | ORF11_13_27255589_27257567_27309940_27312084_FR | N/A | N/A |
| 22 | B | ORF16_21_32136037_32137869_32176222_32178848_RR | N/A | N/A |
| 23 | B | ORF10_3_64194265_64195323_64266976_64268244_FF | N/A | N/A |
| 24 | B | ORF17_16_68696944_68698250_68761044_68765212_RF | N/A | N/A |
| 25 | B | ORF190_8_135269553_135271651_135319729_135326679_RR | N/A | N/A |
| 26 | B | ORF18_12_12622611_12624189_12670151_12671586_RF | N/A | N/A |
| 27 | B | ORF15_2_24032992_24034218_24049864_24051131_RR | N/A | N/A |
| 28 | B | ORF179_16_21255119_21256642_21281450_21284082_FF | N/A | N/A |
| 29 | B | ORF1_2_26896367_26898085_26908272_26910898_RF | N/A | N/A |
| 30 | B | ORF17_16_11953475_11954578_12005204_12009260_FR | N/A | N/A |
| 31 | B | ORF113_2_1847098_1851005_1898477_1903197_FF | N/A | N/A |
| 32 | B | ORF149_11_101998219_102000306_102012864_102014476_RR | N/A | N/A |
| 33 | B | ORF192_19_44155955_44161262_44257710_44261871_RR | N/A | N/A |
| 34 | B | ORF14_3_10153541_10157825_10227245_10228950_RF | N/A | N/A |
| 35 | B | ORF130_6_84763156_84765539_84812997_84816525_FR | N/A | N/A |
| 36 | B | ORF107_20_24351934_24354072_24414516_24420566_FR | N/A | N/A |
| 37 | B | ORF12_20_59933715_59935128_59974481_59977463_FR | N/A | N/A |
| 38 | B | ORF148_9_85858972_85861060_85906428_85910620_FF | N/A | N/A |
| 39 | B | ORF170_1_229849427_229855718_229885230_229889541_FF | N/A | N/A |
| 40 | B | ORF118_5_26939582_26947847_26999889_27004744_RR | N/A | N/A |
| 41 | B | ORF19_20_38250983_38253952_38329699_38336059_RR | N/A | N/A |
| 42 | B | ORF10_1_81802434_81807125_81821654_81825564_FF | N/A | N/A |
| 43 | B | ORF17_10_14331424_14334008_14346291_14350333_RR | N/A | N/A |
| 44 | B | ORF14_1_155821962_155823515_155877897_155879214_FR | N/A | N/A |
| 45 | B | ORF19_1_171350314_171354975_171418199_171422810_FF | N/A | N/A |
| 46 | B | ORF165_3_69184131_69186136_69214794_69217124_FF | N/A | N/A |
| 47 | B | ORF137_7_69585104_69587963_69620592_69625562_RR | N/A | N/A |
| 48 | B | ORF173_16_21214034_21215549_21281450_21284082_FF | N/A | N/A |
| 49 | B | ORF18_12_14122272_14125684_14156567_14160836_FF | N/A | N/A |
| 50 | B | ORF160_2_102946170_102956566_102980783_102983000_FF | N/A | N/A |
| 51 | B | ORF166_20_4539815_4545330_4603849_4605122_FR | N/A | N/A |

TABLE 9.1b

| No. | Group | Probe_Count_Sig | HyperG_Stats | FDR_HyperG | Percent_Sig | logFC | AveExpr |
|-----|-------|-----------------|--------------|------------|-------------|-------|---------|
| 1 | B | N/A | N/A | N/A | N/A | −0.766023397 | −0.766023397 |
| 2 | A | N/A | N/A | N/A | N/A | −0.737400601 | −0.737400601 |
| 3 | A | N/A | N/A | N/A | N/A | −0.736621417 | −0.736621417 |
| 4 | A | N/A | N/A | N/A | N/A | −0.717890738 | −0.717890738 |
| 5 | A | N/A | N/A | N/A | N/A | −0.715992935 | −0.715992935 |
| 6 | A | N/A | N/A | N/A | N/A | −0.676084413 | −0.676084413 |
| 7 | A | N/A | N/A | N/A | N/A | −0.666227638 | −0.666227638 |
| 8 | B | N/A | N/A | N/A | N/A | −0.647142059 | −0.647142059 |
| 9 | A | N/A | N/A | N/A | N/A | −0.63602694 | −0.63602694 |
| 10 | A | N/A | N/A | N/A | N/A | −0.634695914 | −0.634695914 |
| 11 | A | N/A | N/A | N/A | N/A | −0.632299188 | −0.632299188 |
| 12 | A | N/A | N/A | N/A | N/A | −0.631116211 | −0.631116211 |
| 13 | A | N/A | N/A | N/A | N/A | −0.628076664 | −0.628076664 |
| 14 | A | N/A | N/A | N/A | N/A | −0.622972468 | −0.622972468 |
| 15 | A | N/A | N/A | N/A | N/A | −0.621824228 | −0.621824228 |
| 16 | B | N/A | N/A | N/A | N/A | −0.600571735 | −0.600571735 |
| 17 | B | N/A | N/A | N/A | N/A | −0.599730862 | −0.599730862 |
| 18 | B | N/A | N/A | N/A | N/A | −0.59643946 | −0.59643946 |
| 19 | B | N/A | N/A | N/A | N/A | −0.593826424 | −0.593826424 |
| 20 | B | N/A | N/A | N/A | N/A | −0.592608952 | −0.592608952 |
| 21 | B | N/A | N/A | N/A | N/A | −0.5905716 | −0.5905716 |
| 22 | B | N/A | N/A | N/A | N/A | −0.589865679 | −0.589865679 |
| 23 | B | N/A | N/A | N/A | N/A | −0.584702175 | −0.584702175 |
| 24 | B | N/A | N/A | N/A | N/A | −0.581952347 | −0.581952347 |
| 25 | B | N/A | N/A | N/A | N/A | −0.576217342 | −0.576217342 |
| 26 | B | N/A | N/A | N/A | N/A | −0.57612413 | −0.57612413 |
| 27 | B | N/A | N/A | N/A | N/A | −0.573165149 | −0.573165149 |
| 28 | B | N/A | N/A | N/A | N/A | −0.573108965 | −0.573108965 |
| 29 | B | N/A | N/A | N/A | N/A | −0.571566802 | −0.571566802 |
| 30 | B | N/A | N/A | N/A | N/A | −0.57074504 | −0.57074504 |
| 31 | B | N/A | N/A | N/A | N/A | −0.570624243 | −0.570624243 |
| 32 | B | N/A | N/A | N/A | N/A | −0.569711141 | −0.569711141 |
| 33 | B | N/A | N/A | N/A | N/A | −0.56957071 | −0.56957071 |
| 34 | B | N/A | N/A | N/A | N/A | −0.56643324 | −0.56643324 |
| 35 | B | N/A | N/A | N/A | N/A | −0.564870426 | −0.564870426 |
| 36 | B | N/A | N/A | N/A | N/A | −0.562624747 | −0.562624747 |
| 37 | B | N/A | N/A | N/A | N/A | −0.557490402 | −0.557490402 |
| 38 | B | N/A | N/A | N/A | N/A | −0.557072352 | −0.557072352 |
| 39 | B | N/A | N/A | N/A | N/A | −0.554938528 | −0.554938528 |
| 40 | B | N/A | N/A | N/A | N/A | −0.549675937 | −0.549675937 |
| 41 | B | N/A | N/A | N/A | N/A | −0.547447117 | −0.547447117 |
| 42 | B | N/A | N/A | N/A | N/A | −0.546608375 | −0.546608375 |
| 43 | B | N/A | N/A | N/A | N/A | −0.545676557 | −0.545676557 |
| 44 | B | N/A | N/A | N/A | N/A | −0.542994681 | −0.542994681 |
| 45 | B | N/A | N/A | N/A | N/A | −0.541673976 | −0.541673976 |
| 46 | B | N/A | N/A | N/A | N/A | −0.538217184 | −0.538217184 |
| 47 | B | N/A | N/A | N/A | N/A | −0.53392007 | −0.53392007 |
| 48 | B | N/A | N/A | N/A | N/A | −0.532182713 | −0.532182713 |
| 49 | B | N/A | N/A | N/A | N/A | −0.531690361 | −0.531690361 |
| 50 | B | N/A | N/A | N/A | N/A | −0.531489225 | −0.531489225 |
| 51 | B | N/A | N/A | N/A | N/A | −0.53052259 | −0.53052259 |

TABLE 9.1c

| No. | Group | t | P. Value | adj. P. Val | B | FC |
|-----|-------|---|----------|-------------|---|-----|
| 1 | B | −2.306042889 | 0.039866719 | 0.10088678 | −4.676737602 | 0.588036089 |
| 2 | A | −7.374301451 | 0.00000883 | 0.000292636 | 3.834979572 | 0.599819113 |
| 3 | A | −6.21630455 | 0.0000458 | 0.00086 | 2.14521907 | 0.600143156 |
| 4 | A | −7.239266686 | 0.0000106 | 0.000327941 | 3.647395871 | 0.607985685 |
| 5 | A | −4.638823995 | 0.000579337 | 0.004984216 | −0.459547887 | 0.60878599 |
| 6 | A | −10.76833726 | 0.000000168 | 0.0000254 | 7.843989171 | 0.625861609 |
| 7 | A | −6.576257223 | 0.0000270 | 0.00060633 | 2.690445925 | 0.630152259 |
| 8 | B | −6.022669472 | 0.0000614 | 0.001050207 | 1.844287303 | 0.638544 |
| 9 | A | −4.915794296 | 0.000361906 | 0.003583857 | 0.022198152 | 0.643482608 |
| 10 | A | −8.950411064 | 0.00000122 | 0.0000840 | 5.854625604 | 0.644076557 |
| 11 | A | −7.655786319 | 0.00000607 | 0.0002294 | 4.218289153 | 0.64514744 |
| 12 | A | −5.163922573 | 0.000239554 | 0.002683371 | 0.445398777 | 0.645676663 |
| 13 | A | −5.179949705 | 0.000233322 | 0.002635975 | 0.472450904 | 0.647038443 |
| 14 | A | −5.179107163 | 0.000233645 | 0.002638339 | 0.471029649 | 0.649331693 |
| 15 | A | −11.80406641 | 0.0000000613 | 0.0000138 | 8.841413549 | 0.649848701 |
| 16 | B | −3.399761045 | 0.0053096 | 0.023575727 | −2.705260335 | 0.659492549 |
| 17 | B | −4.976237297 | 0.000327043 | 0.003342724 | 0.12603745 | 0.659877045 |
| 18 | B | −5.236449377 | 0.000212681 | 0.002478314 | 0.567537287 | 0.661384225 |
| 19 | B | −5.077748476 | 0.000276195 | 0.002962952 | 0.299350813 | 0.662583222 |

TABLE 9.1c-continued

| No. | Group | t | P. Value | adj. P. Val | B | FC |
|---|---|---|---|---|---|---|
| 20 | B | −5.897714777 | 0.0000744 | 0.001197159 | 1.647245776 | 0.663142603 |
| 21 | B | −7.852473041 | 0.00000470 | 0.000196323 | 4.480059218 | 0.664079745 |
| 22 | B | −8.231687828 | 0.00000290 | 0.000144892 | 4.971082696 | 0.664404763 |
| 23 | B | −7.853615673 | 0.00000469 | 0.000196129 | 4.481565602 | 0.666786974 |
| 24 | B | −5.936345249 | 0.0000701 | 0.001148541 | 1.708400927 | 0.668059105 |
| 25 | B | −6.658340911 | 0.0000239 | 0.000561201 | 2.812218346 | 0.670720061 |
| 26 | B | −7.818480733 | 0.00000491 | 0.000201589 | 4.435170262 | 0.670763397 |
| 27 | B | −6.927616081 | 0.0000163 | 0.000435268 | 3.205101362 | 0.672140551 |
| 28 | B | −2.486588452 | 0.028703988 | 0.080198262 | −4.363759503 | 0.672166727 |
| 29 | B | −5.633193288 | 0.000112392 | 0.001580756 | 1.222758784 | 0.672885622 |
| 30 | B | −6.317387757 | 0.0000394 | 0.000777982 | 2.300188216 | 0.673269007 |
| 31 | B | −8.08428426 | 0.00000350 | 0.000162835 | 4.782324644 | 0.673325383 |
| 32 | B | −4.496046982 | 0.000741289 | 0.005894929 | −0.711493194 | 0.673751675 |
| 33 | B | −5.741966192 | 0.0000947 | 0.00140648 | 1.398518872 | 0.67381726 |
| 34 | B | −4.049117715 | 0.001629916 | 0.010132186 | −1.513989898 | 0.675284225 |
| 35 | B | −8.82030856 | 0.00000142 | 0.0000922 | 5.699089219 | 0.676016129 |
| 36 | B | −8.589705702 | 0.00000187 | 0.000110232 | 5.418692142 | 0.677069226 |
| 37 | B | −7.269873796 | 0.0000102 | 0.000319841 | 3.690126651 | 0.679483111 |
| 38 | B | −14.6932109 | 0.00000000526 | 0.00000401 | 11.20861049 | 0.679680034 |
| 39 | B | −7.340157635 | 0.00000925 | 0.000301595 | 3.787777594 | 0.680686061 |
| 40 | B | −14.89752535 | 0.00000000449 | 0.00000374 | 11.35629626 | 0.683173568 |
| 41 | B | −7.958150912 | 0.00000410 | 0.000179942 | 4.618685614 | 0.684229819 |
| 42 | B | −5.346720359 | 0.000177736 | 0.002185352 | 0.751855048 | 0.684627726 |
| 43 | B | −3.581214225 | 0.00380418 | 0.018301973 | −2.370744948 | 0.685070061 |
| 44 | B | −7.767287642 | 0.00000525 | 0.000210217 | 4.367290619 | 0.686344746 |
| 45 | B | −12.25405337 | 0.0000000405 | 0.0000114 | 9.247930639 | 0.686973343 |
| 46 | B | −6.271807838 | 0.0000422 | 0.000814291 | 2.230490499 | 0.68862135 |
| 47 | B | −6.822148733 | 0.0000189 | 0.00048146 | 3.052417431 | 0.690675489 |
| 48 | B | −2.876798384 | 0.013979113 | 0.047496423 | −3.665275055 | 0.691507732 |
| 49 | B | −4.093140425 | 0.001506656 | 0.00957795 | −1.434120488 | 0.691743764 |
| 50 | B | −8.677436064 | 0.00000168 | 0.000102953 | 5.526084152 | 0.691840212 |
| 51 | B | −7.235636881 | 0.0000107 | 0.000329027 | 3.642319965 | 0.692303914 |

TABLE 9.1d

| No. | Group | FC_1 | LS | Loop Detected |
|---|---|---|---|---|
| 1 | B | −1.700575899 | −1 | Mild Autism |
| 2 | A | −1.667169282 | −1 | Mild Autism |
| 3 | A | −1.666269105 | −1 | Mild Autism |
| 4 | A | −1.644775566 | −1 | Mild Autism |
| 5 | A | −1.642613358 | −1 | Mild Autism |
| 6 | A | −1.597797318 | −1 | Mild Autism |
| 7 | A | −1.586918061 | −1 | Mild Autism |
| 8 | B | −1.566062792 | −1 | Mild Autism |
| 9 | A | −1.554043556 | −1 | Mild Autism |
| 10 | A | −1.552610462 | −1 | Mild Autism |
| 11 | A | −1.550033277 | −1 | Mild Autism |
| 12 | A | −1.548762806 | −1 | Mild Autism |
| 13 | A | −1.545503224 | −1 | Mild Autism |
| 14 | A | −1.540044959 | −1 | Mild Autism |
| 15 | A | −1.538819725 | −1 | Mild Autism |
| 16 | B | −1.516317358 | −1 | Mild Autism |
| 17 | B | −1.515433833 | −1 | Mild Autism |
| 18 | B | −1.511980423 | −1 | Mild Autism |
| 19 | B | −1.509244374 | −1 | Mild Autism |
| 20 | B | −1.50797128 | −1 | Mild Autism |
| 21 | B | −1.505843248 | −1 | Mild Autism |
| 22 | B | −1.505106609 | −1 | Mild Autism |
| 23 | B | −1.499729358 | −1 | Mild Autism |
| 24 | B | −1.496873544 | −1 | Mild Autism |
| 25 | B | −1.490934979 | −1 | Mild Autism |
| 26 | B | −1.490838654 | −1 | Mild Autism |

TABLE 9.1d-continued

| No. | Group | FC_1 | LS | Loop Detected |
|---|---|---|---|---|
| 27 | B | −1.487784063 | −1 | Mild Autism |
| 28 | B | −1.487726125 | −1 | Mild Autism |
| 29 | B | −1.486136675 | −1 | Mild Autism |
| 30 | B | −1.48529041 | −1 | Mild Autism |
| 31 | B | −1.485166051 | −1 | Mild Autism |
| 32 | B | −1.484226366 | −1 | Mild Autism |
| 33 | B | −1.4840819 | −1 | Mild Autism |
| 34 | B | −1.480857931 | −1 | Mild Autism |
| 35 | B | −1.479254646 | −1 | Mild Autism |
| 36 | B | −1.47695385 | −1 | Mild Autism |
| 37 | B | −1.471706925 | −1 | Mild Autism |
| 38 | B | −1.47128053 | −1 | Mild Autism |
| 39 | B | −1.469106034 | −1 | Mild Autism |
| 40 | B | −1.463756865 | −1 | Mild Autism |
| 41 | B | −1.461497252 | −1 | Mild Autism |
| 42 | B | −1.460647826 | −1 | Mild Autism |
| 43 | B | −1.459704718 | −1 | Mild Autism |
| 44 | B | −1.456993742 | −1 | Mild Autism |
| 45 | B | −1.455660557 | −1 | Mild Autism |
| 46 | B | −1.452176875 | −1 | Mild Autism |
| 47 | B | −1.447857954 | −1 | Mild Autism |
| 48 | B | −1.446115429 | −1 | Mild Autism |
| 49 | B | −1.445621994 | −1 | Mild Autism |
| 50 | B | −1.445420464 | −1 | Mild Autism |
| 51 | B | −1.444452328 | −1 | Mild Autism |

TABLE 9.1e

| No. | Group | Probe sequence 60 mer | Probe Location Chr |
|---|---|---|---|
| 1 | B | GTGTCTGTTCAAATTCTTTACCCATTTTTCGATGCTTTACTTTTGAGTTTGGGGGATGTC (SEQ ID NO: 4151) | X |
| 2 | A | ACAGATTAAAACTATGAGGATATACCATTCGAGTAATATTAAAGATTCCAGGACTCACAA (SEQ ID NO: 1127) | 12 |

TABLE 9.1e-continued

| No. | Group | Probe sequence 60 mer | Probe Location Chr |
|-----|-------|------------------------|--------------------|
| 3 | A | GGGCTAACTTTATATTTTATAAATGTAGTCGATCTTCGTTTGAAACACAAGGTCTATCAC (SEQ ID NO: 1334) | 2 |
| 4 | A | TTTGGATGTGTCATAATCTACTTAAAATTCGATACTTATCTTTACAAAACGCAAGAATAA (SEQ ID NO: 1398) | 3 |
| 5 | A | CCAGCTTATTCTAAGTCCTCAATAAATCTCGAGAACAGCTACTTTCTATCTTCTGTTACA (SEQ ID NO: 1092) | 2 |
| 6 | A | AAATATCAGGAGAATCCACATAGTAGTCTCGAACATCAGACTTGAATTTCTTGTTTTGGA (SEQ ID NO: 1098) | 7 |
| 7 | A | ATTCTTTTAAACCTAAAATTAGACTGCTTCGACAAATTTATGATGCCTACATCATGAAGG (SEQ ID NO: 1348) | 22 |
| 8 | B | TTTAAATATTTTAAATATTTTTAAAATATCGATTCTACTCCTCCAGGTTGCAGGCAGAGC (SEQ ID NO: 4158) | 1 |
| 9 | A | GACCACAAAGTGAAGGTAAAAATAAAATTCGACTTTACAAATAATAATAATAGTCCAATG (SEQ ID NO: 1097) | X |
| 10 | A | CTGCTAATTTTAATTCACTAAGAAACTATCGATATACCATAGGTGTATAGTAGGTTATGC (SEQ ID NO: 1152) | 6 |
| 11 | A | TCTTTTCTTCCTTTTCTCTTTCTTCCTTTCGACTATTTTATTTTTTGTAGAGACGAGATC (SEQ ID NO: 1353) | 7 |
| 12 | A | ACATTTATTCCCTAATACTCTTCTCTGTTCGACAAAATTATCCTTCAAAAATGAAGGAGA (SEQ ID NO: 1150) | 1 |
| 13 | A | AGGACAGAGTTTCAGAGTAAAATTTAATTCGAAAAACAAAAATAATAAATGCAATATTGA (SEQ ID NO: 1338) | 12 |
| 14 | A | GATTCAGAATGTCTAGTATTTTATTCAATCGATTGATTTTTCCAAAATCACTGCTTCAAA (SEQ ID NO: 1355) | 3 |
| 15 | A | TTTTCCAGTCCTATTTTCTATGGCAATGTCGAAAGTCTTTGAAAATAAACTCACCTAACG (SEQ ID NO: 1083) | 7 |
| 16 | B | ATGAACAGGATATGTAATAATGGTATTATCGAGTCCCTTAAAAAATTTTAAAGGGGGAAA (SEQ ID NO: 4166) | 9 |
| 17 | B | ATTGTGACAATCACATTTTAAGTACTCTTCGATATTCCCGTGTTCATTGTTAATTGTTTT (SEQ ID NO: 4167) | 3 |
| 18 | B | TTGCTTTTTTATTTTTATTTTTTATTTTTCGACCTCACATGCCTCTTACATAGGCTTGAA (SEQ ID NO: 4168) | 16 |
| 19 | B | ATCTTCTTTTTTTCAAAAGTATCCTAAGTCGAAGACGCACATTTTTTTCACATTTCAACA (SEQ ID NO: 4169) | 3 |
| 20 | B | CCAGAGTAGTAAAATTGTGCTTTCTAATTCGAATACTTCCTGGACTCATCAAATTAAATG (SEQ ID NO: 4170) | 10 |
| 21 | B | AGATCCCTTGTACACTGTATACTGTTTGTCGAATACATTTTTCTCTTTGAGTGGGAAGAA (SEQ ID NO: 4171) | 13 |
| 22 | B | GTCTCAGTTCCACTGAGCATCTTGTACTTCGAGTATTATGTACTATACGTAATTGTATGT (SEQ ID NO: 4172) | 21 |
| 23 | B | GCATTTTTATGAAATTAAATGTCCGTATTCGAGATTTTCACCAATAAGCTGAGTGGGAGG (SEQ ID NO: 4173) | 3 |
| 24 | B | TTGCTTTTTTATTTTTATTTTTTATTTTTCGACCTCACATGCCTCTTACATAGGCTTGAA (SEQ ID NO: 4168) | 16 |
| 25 | B | GTGTGTTAATAGAAGTAATATCACACTATCGATATACCTTTGCCACATGACCTATCAATA (SEQ ID NO: 4175) | 8 |
| 26 | B | TGGGTATATTTTCTTTTTGTTTGGAAACTCGACTAGAAAAACTGGCAGAAAGGTTAGCAG (SEQ ID NO: 4176) | 12 |
| 27 | B | ACACATTCCTTTCTTAAGAAATGTTAACTCGAGACCATCTCCCCCGGAGACGGTACCGGG (SEQ ID NO: 4177) | 2 |
| 28 | B | TTTTTTTTTTTTTAACATCTGTCTTCTCTTCGAGCTCCGCGCGCCGACCACGGGCAGCGGG | 16 |

TABLE 9.1e-continued

| No. | Group | Probe sequence 60 mer | Probe Location Chr |
|---|---|---|---|
| | | (SEQ ID NO: 4178) | |
| 29 | B | GTAGTTTTTAATTTTGAAGTCCAATTTATCGACATCTGATTTCATTTCCCTTGGATATAT (SEQ ID NO: 4179) | 2 |
| 30 | B | TAAAATTTTTTTTAAGAAGAAAAAAGACTCGACTGATTGATCAATTTAGTCCTTCTTGAG (SEQ ID NO: 4180) | 16 |
| 31 | B | CCATCTTTAACAAGTGGTAAATTTTTTCTCGAGAAATATTCCAAGACCTCGTTTGAATAC (SEQ ID NO: 4181) | 2 |
| 32 | B | CATGTATGAAATATGAAATTTGGAAGAATCGACTGCCACTATTTCACAGGTGATGACCTG (SEQ ID NO: 4182) | 11 |
| 33 | B | CATGATACAAATTGTACTGCCATTTCCATCGACTTAGGTAAAAAACTTGACAAGAGACAA (SEQ ID NO: 4183) | 19 |
| 34 | B | GATATTTGTAGTGGCATTTTTTTTTTTTCGAATCTTGTGAATGTATTAAATATATCGCT (SEQ ID NO: 4184) | 3 |
| 35 | B | TTTGTACAATTTGTTTTGTAGTTTCAACTCGATGATCAGCAAGAGCTTTTCTTCTTGCTG (SEQ ID NO: 4185) | 6 |
| 36 | B | TTTTTATCTCTTCTAGATTTTGTCTTCCTCGATGTTGCTGATGCTACCAGGCTTAACAGG (SEQ ID NO: 4186) | 20 |
| 37 | B | ATAATGTATAACACAAAATGTAAGAAGATCGAAGTTGAGTTGGAAATGCTTGGTGCATCA (SEQ ID NO: 1624) | 20 |
| 38 | B | ATGAGAAACCTAAGGTCAGTTCTGGCTTTCGATACAAAGATTATAAATAAAATTGGCTGG (SEQ ID NO: 4188) | 9 |
| 39 | B | AACCGGTTTTGTCACAAACATTGAAAAATCGATTATGAACTCAGAGACCAGGAAAATGAA (SEQ ID NO: 4189) | 1 |
| 40 | B | TGCCGCATTTTTTGAATAAATTCACACATCGAAGAAAATGCTGAAGAATATCTTAATGAC (SEQ ID NO: 4190) | 5 |
| 41 | B | CATCATCAGTTTATTTTTGGAGTTACATTCGAAACCCTGCTTTATTTTATTTATTTTTTT (SEQ ID NO: 4191) | 20 |
| 42 | B | AGCTAAAAACTTTTCAAATTGATAGATTTCGAGACCATCTTGGCCAAGATGGTGAAATCC (SEQ ID NO: 4192) | 1 |
| 43 | B | ATTAATTTCTTCCCCCTAGTTTCTTATTTCGAATTATTTAGATGATTGTCTCAATATTCC (SEQ ID NO: 1680) | 10 |
| 44 | B | TGTTTTGTCCAGAAATAAGACACAGATGTCGACTTTAGCTCATTTTCCACCTTTCTCTGA (SEQ ID NO: 4194) | 1 |
| 45 | B | TTCTCAAACTCTTCTTATGTTCAAACTGTCGATCTCTGGCTTTGGCTTCCCAAAGCACTG (SEQ ID NO: 4195) | 1 |
| 46 | B | ATTACATTAAGTGAAATGTTAACTTCATTCGATATTCCCGTGTTCATTGTTAATTGTTTT (SEQ ID NO: 4196) | 3 |
| 47 | B | AGTATGGAATATACTTTAGATAATAGTGTCGACTACAGAAAAAATATTCCCAGCACGTAA (SEQ ID NO: 4197) | 7 |
| 48 | B | TTGCTTTAATAGGAAAATGAAAAACCTGTCGAGCTCCGCGCGCCGACCACGGGCAGCGGG (SEQ ID NO: 4198) | 16 |
| 49 | B | TCAAATTTCAACATAAGATTTGAAAAGTCGAATATATATTAAACATCTACACTGTGTCA (SEQ ID NO: 4199) | 12 |
| 50 | B | TTCTCTTCTTTATTGCATTAATCTGGTTTCGATGGGCCCTCTTTCCAAAAATGCAGGTAT (SEQ ID NO: 4200) | 2 |
| 51 | B | AACTTTGGGTTTAGTTTGTTCGTCTTTCTCGAACATTCTCCTGGCTGTTTACGTTTACAG (SEQ ID NO: 4201) | 20 |

TABLE 9.1f

| No. | Group | Probe Location | | | | 4 kb Sequence Location | |
|---|---|---|---|---|---|---|---|
| | | Start1 | End1 | Start2 | End2 | Chr | Start1 |
| 1 | B | 140892356 | 140892385 | 140927451 | 140927480 | X | 140888386 |
| 2 | A | 10158041 | 10158070 | 10186676 | 10186705 | 12 | 10154071 |
| 3 | A | 156267571 | 156267600 | 156333730 | 156333759 | 2 | 156263601 |
| 4 | A | 168579834 | 168579863 | 168632647 | 168632676 | 3 | 168579834 |
| 5 | A | 20457877 | 20457906 | 20490255 | 20490284 | 2 | 20453907 |
| 6 | A | 38594691 | 38594720 | 38633654 | 38633683 | 7 | 38594691 |
| 7 | A | 25661629 | 25661658 | 25695448 | 25695477 | 22 | 25661629 |
| 8 | B | 230002406 | 230002435 | 230050799 | 230050828 | 1 | 230002406 |
| 9 | A | 39224583 | 39224612 | 39309663 | 39309692 | X | 39224583 |
| 10 | A | 146070956 | 146070985 | 146155394 | 146155423 | 6 | 146066986 |
| 11 | A | 112014906 | 112014935 | 112124187 | 112124216 | 7 | 112014906 |
| 12 | A | 77410773 | 77410802 | 77425168 | 77425197 | 1 | 77406803 |
| 13 | A | 82610099 | 82610128 | 82624219 | 82624248 | 12 | 82606129 |
| 14 | A | 177784072 | 177784101 | 177834794 | 177834823 | 3 | 177780102 |
| 15 | A | 107580953 | 107580982 | 107700114 | 107700143 | 7 | 107580953 |
| 16 | B | 106279288 | 106279317 | 106324003 | 106324032 | 9 | 106279288 |
| 17 | B | 69172531 | 69172560 | 69217093 | 69217121 | 3 | 69168561 |
| 18 | B | 68696946 | 68696975 | 68765181 | 68765210 | 16 | 68696946 |
| 19 | B | 57938940 | 57938969 | 57950734 | 57950763 | 3 | 57934970 |
| 20 | B | 112482466 | 112482495 | 112554880 | 112554909 | 10 | 112478496 |
| 21 | B | 27257536 | 27257565 | 27309942 | 27309971 | 13 | 27253566 |
| 22 | B | 32136039 | 32136068 | 32176224 | 32176253 | 21 | 32136039 |
| 23 | B | 64195292 | 64195321 | 64268213 | 64268242 | 3 | 64191322 |
| 24 | B | 68696946 | 68696975 | 68765181 | 68765210 | 16 | 68696946 |
| 25 | B | 135269555 | 135269584 | 135319731 | 135319760 | 8 | 135269555 |
| 26 | B | 12622613 | 12622642 | 12671555 | 12671584 | 12 | 12622613 |
| 27 | B | 24032994 | 24033023 | 24049866 | 24049895 | 2 | 24032994 |
| 28 | B | 21256611 | 21256640 | 21284051 | 21284080 | 16 | 21252641 |
| 29 | B | 26896369 | 26896398 | 26910867 | 26910896 | 2 | 26896369 |
| 30 | B | 11954547 | 11954576 | 12005206 | 12005235 | 16 | 11950577 |
| 31 | B | 1850974 | 1851003 | 1903166 | 1903195 | 2 | 1847004 |
| 32 | B | 101998221 | 101998250 | 102012866 | 102012895 | 11 | 101998221 |
| 33 | B | 44155957 | 44155986 | 44257712 | 44257741 | 19 | 44155957 |
| 34 | B | 10153543 | 10153572 | 10228919 | 10228948 | 3 | 10153543 |
| 35 | B | 84765508 | 84765537 | 84812999 | 84813028 | 6 | 84761538 |
| 36 | B | 24354041 | 24354070 | 24414518 | 24414547 | 20 | 24350071 |
| 37 | B | 59935097 | 59935126 | 59974483 | 59974512 | 20 | 59931127 |
| 38 | B | 85861029 | 85861058 | 85910589 | 85910618 | 9 | 85857059 |
| 39 | B | 229855687 | 229855716 | 229889510 | 229889539 | 1 | 229851717 |
| 40 | B | 26939584 | 26939613 | 26999891 | 26999920 | 5 | 26939584 |
| 41 | B | 38250985 | 38251014 | 38329701 | 38329730 | 20 | 38250985 |
| 42 | B | 81807094 | 81807123 | 81825533 | 81825562 | 1 | 81803124 |
| 43 | B | 14331426 | 14331455 | 14346293 | 14346322 | 10 | 14331426 |
| 44 | B | 155823484 | 155823513 | 155877899 | 155877928 | 1 | 155819514 |
| 45 | B | 171354944 | 171354973 | 171422779 | 171422808 | 1 | 171350974 |
| 46 | B | 69186105 | 69186134 | 69217093 | 69217122 | 3 | 69182135 |
| 47 | B | 69585106 | 69585135 | 69620594 | 69620623 | 7 | 69585106 |
| 48 | B | 21215518 | 21215547 | 21284051 | 21284080 | 16 | 21211548 |
| 49 | B | 14125653 | 14125682 | 14160805 | 14160834 | 12 | 14121683 |
| 50 | B | 102956535 | 102956564 | 102982969 | 102982998 | 2 | 102952565 |
| 51 | B | 4545299 | 4545328 | 4603851 | 4603880 | 20 | 4541329 |

TABLE 9.1g

| No. | Group | B 4 kb Sequence Location | | | Probe |
|---|---|---|---|---|---|
| | | End1 | Start2 | End2 | |
| 1 | B | 140892385 | 140923481 | 140927480 | ORF1_X_140889640_140892387_140922520_140927482_FF |
| 2 | A | 10158070 | 10186676 | 10190675 | ORF13_12_10157054_10158072_10186674_10187896_FR |
| 3 | A | 156267600 | 156333730 | 156337729 | ORF150_2_156262877_156267602_156333728_156335220_FR |
| 4 | A | 168583833 | 168628677 | 168632676 | ORF191_3_168579832_168593354_168619477_168632678_RF |
| 5 | A | 20457906 | 20490255 | 20494254 | ORF101_2_20454246_20457908_20490253_20493006_FR |
| 6 | A | 38598690 | 38633654 | 38637653 | ORF107_7_38594689_38595956_38633652_38638705_RR |
| 7 | A | 25665628 | 25691478 | 25695477 | ORF16_22_25661627_25666380_25694410_25695479_RF |
| 8 | B | 230006405 | 230046829 | 230050828 | ORF18_1_230002404_230003670_230047264_230050830_RF |
| 9 | A | 39228582 | 39305693 | 39309692 | ORF106_X_39224581_39226649_39303922_39309694_RF |
| 10 | A | 146070985 | 146155394 | 146159393 | ORF143_6_146066540_146070987_146155392_146161780_FR |
| 11 | A | 112018905 | 112124187 | 112128186 | ORF161_7_112014904_112016980_112124185_112133295_RR |
| 12 | A | 77410802 | 77425168 | 77429167 | ORF141_1_77409324_77410804_77425166_77437348_FR |
| 13 | A | 82610128 | 82624219 | 82628218 | ORF152_12_82605920_82610130_82624217_82631901_FR |
| 14 | A | 177784101 | 177830824 | 177834823 | ORF163_3_177780034_177784103_177831413_177834825_FF |
| 15 | A | 107584952 | 107696144 | 107700143 | ORF1_7_107580951_107585747_107694264_107700145_RF |

TABLE 9.1g-continued

| | B | | 4 kb Sequence Location | | |
|---|---|---|---|---|---|
| No. | Group | End1 | Start2 | End2 | Probe |
| 16 | B | 106283287 | 106320033 | 106324032 | ORF194_9_106279286_106287735_106321634_106324034_RF |
| 17 | B | 69172560 | 69213123 | 69217122 | ORF186_3_69167897_69172562_69214794_69217124_FF |
| 18 | B | 68700945 | 68761211 | 68765210 | ORF196_16_68696944_68698250_68761044_68765212_RF |
| 19 | B | 57946764 | 57938969 | 57950763 | ORF14_3_57937518_57938969_57949710_57950765_FF |
| 20 | B | 112482495 | 112550910 | 112554909 | ORF102_10_112480267_112482497_112548771_112554911_FF |
| 21 | B | 27257565 | 27309942 | 27313941 | ORF11_13_27255589_27257567_27309940_27312084_FR |
| 22 | B | 32140038 | 32176224 | 32180223 | ORF16_21_32136037_32137869_32176222_32178848_RR |
| 23 | B | 64195321 | 64264243 | 64268242 | ORF10_3_64194265_64195323_64266976_64268244_FF |
| 24 | B | 68700945 | 68761211 | 68765210 | ORF17_16_68696944_68698250_68761044_68765212_RF |
| 25 | B | 135273554 | 135319731 | 135323730 | ORF190_8_135269553_135271651_135319729_135326679_RR |
| 26 | B | 12626612 | 12667585 | 12671584 | ORF18_12_12622611_12624189_12670151_12671586_RF |
| 27 | B | 24036993 | 24049866 | 24053865 | ORF15_2_24032992_24034218_24049864_24051131_RR |
| 28 | B | 21256640 | 21280081 | 21284080 | ORF179_16_21255119_21256642_21281450_21284082_FF |
| 29 | B | 26900368 | 26906897 | 26910896 | ORF1_2_26896367_26898085_26908272_26910898_RF |
| 30 | B | 11954576 | 12005206 | 12009205 | ORF17_16_11953475_11954578_12005204_12009260_FR |
| 31 | B | 1851003 | 1899196 | 1903195 | ORF113_2_1847098_1851005_1898477_1903197_FF |
| 32 | B | 102002220 | 102012866 | 102016865 | ORF149_11_101998219_102000306_102012864_102014476_RR |
| 33 | B | 44159956 | 44257712 | 44261711 | ORF192_19_44155955_44161262_44257710_44261871_RR |
| 34 | B | 10157542 | 10224949 | 10228948 | ORF14_3_10153541_10157825_10227245_10228950_RF |
| 35 | B | 84765537 | 84812999 | 84816998 | ORF130_6_84763156_84765539_84812997_84816525_FR |
| 36 | B | 24354070 | 24414518 | 24418517 | ORF107_20_24351934_24354072_24414516_24420566_FR |
| 37 | B | 59935126 | 59974483 | 59978482 | ORF12_20_59933715_59935128_59974481_59977463_FR |
| 38 | B | 85861058 | 85906619 | 85910618 | ORF148_9_85858972_85861060_85906428_85910620_FF |
| 39 | B | 229855716 | 229885540 | 229889539 | ORF170_1_229849427_229855718_229885230_229889541_FF |
| 40 | B | 26943583 | 26999891 | 27003890 | ORF118_5_26939582_26947847_26999889_27004744_RR |
| 41 | B | 38254984 | 38329701 | 38333700 | ORF19_20_38250983_38253952_38329699_38336059_RR |
| 42 | B | 81807123 | 81821563 | 81825562 | ORF10_1_81802434_81807125_81821654_81825564_FF |
| 43 | B | 14335425 | 14346293 | 14350292 | ORF17_10_14331424_14334008_14346291_14350333_RR |
| 44 | B | 155823513 | 155877899 | 155881898 | ORF14_1_155821962_155823515_155877897_155879214_FR |
| 45 | B | 171354973 | 171418809 | 171422808 | ORF19_1_171350314_171354975_171418199_171422810_FF |
| 46 | B | 69186134 | 69213123 | 69217122 | ORF165_3_69184131_69217896_69214794_69217124_FF |
| 47 | B | 69589105 | 69620594 | 69624593 | ORF137_7_69585104_69587963_69620592_69625562_RR |
| 48 | B | 21215547 | 21280081 | 21284080 | ORF173_16_21214034_21215549_21281450_21284082_FF |
| 49 | B | 14125682 | 14156835 | 14160834 | ORF18_12_14122272_14125684_14156567_14160836_FF |
| 50 | B | 102956564 | 102978999 | 102982998 | ORF160_2_102946170_102956566_102980783_102983000_FF |
| 51 | B | 4545328 | 4603851 | 4607850 | ORF166_20_4539815_4545330_4603849_4605122_FR |

TABLE 9.1h

| No. | Group | PCR-Primer1_ID | PCR_Primer1 | PCR-Primer2_ID | PCR_Primer2 |
|---|---|---|---|---|---|
| 1 | B | OBD159_4021 | GGTAGTAGGAATGAAAGAGTAGAAAG (SEQ ID NO: 4202) | OBD159_4023 | GGAGGTGAGGGCATAATAGAAACCAT (SEQ ID NO: 4253) |
| 2 | A | OBD159_885 | CCTGAGCAACAAGAGCGAAACTC (SEQ ID NO: 1209) | OBD159_887 | CATCAGGCTTCTGGGAATGGAAAT (SEQ ID NO: 1291) |
| 3 | A | OBD159_1057 | GAAGTCCATTCTTGGGATGAAACAAA (SEQ ID NO: 1416) | OBD159_1059 | GGCTCTAAGATTGAGGCTGTGAT (SEQ ID NO: 1498) |
| 4 | A | OBD159_1313 | GACATTGGCAGAGGTAAATAAATA (SEQ ID NO: 1480) | OBD159_1315 | CAGTCCAAAAGCCAAGAAAGCATA (SEQ ID NO: 1562) |
| 5 | A | OBD159_745 | GCCCTCTACTGCCTCAGGTTCTT (SEQ ID NO: 1174) | OBD159_747 | TCCGACCAACCCAGACCAACCTG (SEQ ID NO: 1256) |
| 6 | A | OBD159_769 | ATGTCTTTATCTTGCTTCCTTTAGGG (SEQ ID NO: 1180) | OBD159_771 | AGAGCCAGTCCGAGTTCCAAAAC (SEQ ID NO: 1262) |
| 7 | A | OBD159_1113 | TGTGCTAATCTGGAAGACTCTGTC (SEQ ID NO: 1430) | OBD159_1115 | AAGTAACAGAGTAAGAAGAAATAC (SEQ ID NO: 1512) |
| 8 | B | OBD159_4025 | TACTGTACTCCAGCCTGGGTAATAGAGCC (SEQ ID NO: 4209) | OBD159_4027 | ACAAGGGTGGGGTTGGTGGACATTTC (SEQ ID NO: 4260) |
| 9 | A | OBD159_765 | TGAAAGAAAGAGGTTGTCAAGAAT (SEQ ID NO: 1179) | OBD159_767 | TTTTCTGCCTCAGCCTCCCAAGTA (SEQ ID NO: 1261) |
| 10 | A | OBD159_985 | GGCTAAACCCACACCCTGTAATAACC (SEQ ID NO: 1234) | OBD159_987 | CTCTAAGTAAATCCTGGTCATTCCCC (SEQ ID NO: 1316) |
| 11 | A | OBD159_1133 | TGCCACCCAGTAGGTCTCAGTCT (SEQ ID NO: | OBD159_1135 | GAGACCAGGAACTCAGGACCAGC |

TABLE 9.1h-continued

| No. | Group | Primer1_ID | PCR_Primer1 | PCR-Primer2_ID | PCR_Primer2 |
|---|---|---|---|---|---|
| | | | ID NO: 1435) | | (SEQ ID NO: 1517) |
| 12 | A | OBD159_977 | AAGTCAGAAAGCCACAAGATAAAT (SEQ ID NO: 1173) | OBD159_979 | AAAGTGCTGGGATTACAGGCGTGA (SEQ ID NO: 1314) |
| 13 | A | OBD159_1073 | CGTGACGAACTGAAGCAGACCCTTTC (SEQ ID NO: 1420) | OBD159_1075 | CATCCTTTATCTTCCCTACCCCATCA (SEQ ID NO: 1502) |
| 14 | A | OBD159 1141 | ATGTGAGTGTTCCTTGTAGATTAC (SEQ ID NO: 1437) | OBD159_1143 | AGGTCTCAAGCAAGGGAGCAACAT (SEQ ID NO: 1519) |
| 15 | A | OBD159_709 | CAACTGTGACTTGACTCCTTGCTAAG (SEQ ID NO: 1165) | OBD159_711 | CTGAGACAAGGCAGGGCAGGTGTTA (SEQ ID NO: 1247) |
| 16 | B | OBD159_4029 | CACAGCAAGACTCAGGGTGGAACAGC CC (SEQ ID NO: 4217) | OBD159_4031 | GCCCAAACTCACAAAGCCTACAGAGG GA (SEQ ID NO: 4268) |
| 17 | B | OBD159_4033 | TAACTGGTTTTGTATCTAATTTAGTAGT CT (SEQ ID NO: 4218) | OBD159_4035 | TTTACTGGATTAATTCTTAGTTGAA (SEQ ID NO: 4269) |
| 18 | B | OBD159_4037 | TTTGGAAAGAGGCATCACTTTTAT (SEQ ID NO: 4219) | OBD159_4039 | CAAGAGATTGAGACTATCCTGGCCAAC (SEQ ID NO: 4270) |
| 19 | B | OBD159_4041 | TGGGATTTCAGGCCTGAGCCACC (SEQ ID NO: 4220) | OBD159_4043 | TTGCCCAGGCTGGAGTGTAGTGGC (SEQ ID NO: 4271) |
| 20 | B | OBD159_4045 | GGGCTTTCTCCCTACTCTGTTTAGA (SEQ ID NO: 4221) | OBD159_4047 | CTCCCACTCTCTACCTCTCCCTAAGT (SEQ ID NO: 4272) |
| 21 | B | OBD159_4049 | GCTGGCAGGTTCGGTGTCTTGTG (SEQ ID NO: 4222) | OBD159_4051 | GACCCGTCCCCTGATAACTGATG (SEQ ID NO: 4273) |
| 22 | B | OBD159_4053 | CTTCTCAGGTGCTGCCCTCCTCCG (SEQ ID NO: 4223) | OBD159_4055 | GCTCAATGAACTATGTGCTGCTGTAAG C (SEQ ID NO: 4274) |
| 23 | B | OBD159_4057 | ACCCCTTATTTGGAGTGAGCAGAGGCA A (SEQ ID NO: 4224) | OBD159_4059 | GGGCTCCGCACAAGGCAGGTAACATT CC (SEQ ID NO: 4275) |
| 24 | B | OBD159_4061 | CCAATATTAAAATGCATCACCAAACC (SEQ ID NO: 4225) | OBD159_4063 | GGCAGGAGAATCGCTTGAACCCAGGA (SEQ ID NO: 4276) |
| 25 | B | OBD159_4065 | GAGATGGCTTGATTGTCTTGCCCAAC (SEQ ID NO: 4226) | OBD159_4067 | GCTTCCCATTAGCACAACACTGCCAA (SEQ ID NO: 4277) |
| 26 | B | OBD159_4069 | ACCTGAAACTCCTGGTGCCACAAGC (SEQ ID NO: 4227) | OBD159_4071 | AAGTCTACTCACATCTTCCTGCTGCT (SEQ ID NO: 4278) |
| 27 | B | OBD159_4073 | GTGTCTCTCAGGCTGCTGTCCATCATCC (SEQ ID NO: 4228) | OBD159_4075 | ACCCTCCACGCCACCTCCGAATCAGAC C (SEQ ID NO: 4279) |
| 28 | B | OBD159_4077 | ATCCGCCTGCCTTGGCCTCCCAAAGTG (SEQ ID NO: 4229) | OBD159_4079 | GGTTGGGGCTCCTCATCCCAACA (SEQ ID NO: 4280) |
| 29 | B | OBD159_4081 | GCCCGCCCCAGCCTCCCAAAGTGC (SEQ ID NO: 4230) | OBD159_4083 | GATAATCTCATTGTGGTTTTAACTTGT (SEQ ID NO: 4281) |
| 30 | B | OBD159_4085 | GGAGGCTGAGGCAGAAGATAGA (SEQ ID NO: 4231) | OBD159_4087 | TTGATTAATGATCCTGTGTCTAAGT (SEQ ID NO: 4282) |
| 31 | B | OBD159_4089 | CCCACCCCGCTTGAATAGTCTGG (SEQ ID NO: 4232) | OBD159_4091 | GAGTGACCACCACCGCTCAACTA (SEQ ID NO: 4283) |
| 32 | B | OBD159_4093 | ATCTGTCTACCTCGGCCTGCAAAG (SEQ ID NO: 4233) | OBD159_4095 | TGCTTACAAAGAGATCCTTATCACCCT G (SEQ ID NO: 4284) |
| 33 | B | OBD159_4097 | ATGTCGTCCTGCTTCTGGAACAGTCTC (SEQ ID NO: 4234) | OBD159_4099 | TATGTATTCTGCTGGTTTTAGGTGGG (SEQ ID NO: 4285) |
| 34 | B | OBD159_4101 | CCTCCTCCAGGCTTGGGAAAGTG (SEQ ID NO: 4235) | OBD159_4103 | CACCACACAACACACCCTGCCTA (SEQ ID NO: 4286) |
| 35 | B | OBD159_4105 | GCACGCCCTTTCCGCAGCCCACCTTTTC (SEQ ID NO: 4236) | OBD159_4107 | CTCAGTCACCTGGCTACACCCAAGTGC (SEQ ID NO: 4287) |
| 36 | B | OBD159_4109 | CTATTTGCTGAAGGTTGAGTAGTCTT (SEQ ID NO: 4237) | OBD159_4111 | TAAGGGCTCACCAGCATTGGATTTGG (SEQ ID NO: 4288) |

TABLE 9.1h-continued

| No. | Group | Primer1_ID | PCR_Primer1 | PCR-Primer2_ID | PCR_Primer2 |
|---|---|---|---|---|---|
| 37 | B | OBD159_4113 | CTCAGTTGTGGACCAGAGCAGAT (SEQ ID NO: 1734) | OBD159_4115 | CACCCCACACTGTCACTCTTTGCTCT (SEQ ID NO: 1844) |
| 38 | B | OBD159_4117 | CTGTCAGCATTGTGGGCAAGACCCTGG G (SEQ ID NO: 4239) | OBD159_4119 | GGAAAGGTAGGGCACGCCTGTCATCC C (SEQ ID NO: 4290) |
| 39 | B | OBD159_4121 | GCTTTGCTTCACAGGCTTGCCCA (SEQ ID NO: 1434) | OBD159_4123 | CTGACACGATGGGACCAGTGCCA (SEQ ID NO: 4291) |
| 40 | B | OBD159_4125 | CAATTCTCTATGGTATATTATTGTTCTT (SEQ ID NO: 4241) | OBD159_4127 | AAATATTTGTAACACATATCTGATAAG (SEQ ID NO: 4292) |
| 41 | B | OBD159_4129 | TTAAAGTAGTTTATTTTCACAGAAA (SEQ ID NO: 4242) | OBD159_4131 | GTCTTGAACTCCTGACTTCAAGTG (SEQ ID NO: 4293) |
| 42 | B | OBD159_4133 | ATCTGATTTTGAGTCTTGAAGGGAG (SEQ ID NO: 4243) | OBD159_4135 | GCTCAGCTAAGAGTGCAATGGC (SEQ ID NO: 4294) |
| 43 | B | OBD159_4137 | AAGTGCTGGGAATGCAGGTGTGA (SEQ ID NO: 4244) | OBD159_4139 | CCTTGTAACACATACAACCACTGGATT T (SEQ ID NO: 4295) |
| 44 | B | OBD159_4141 | TAACAAAATGAAAGAGAAAAAAACA (SEQ ID NO: 4245) | OBD159_4143 | GGCGGATTGCTTGACCCCAGGAA (SEQ ID NO: 4296) |
| 45 | B | OBD159_4145 | GCAACTGGGTAGTCTTCCTCGGG (SEQ ID NO: 4246) | OBD159_4147 | CACACCCACGAGTCAGAGGTAAC (SEQ ID NO: 4297) |
| 46 | B | OBD159_4149 | GCTACTTGGAAGGCTGAGGGGGGAGA A (SEQ ID NO: 4247) | OBD159_4151 | TACTGGATTAATTCTTAGTTGAA (SEQ ID NO: 4298) |
| 47 | B | OBD159_4153 | GGCAGAAGACACAGTGGGACCAGGG (SEQ ID NO: 4248) | OBD159_4155 | CATTTTCCACCCACCTTCCCACACCCG (SEQ ID NO: 4299) |
| 48 | B | OBD159_4157 | GCCTCATTTGGGCAGATGTCTTCCTTTC (SEQ ID NO: 4249) | OBD159_4159 | GCGGCGGCGAGGCTTGAGCAGTG (SEQ ID NO: 4300) |
| 49 | B | OBD159_4161 | CCATTAGGCTCCCACATCCAACATTG (SEQ ID NO: 4250) | OBD159_4163 | GCCCACCCCATAGTAAAAGACTTGAC (SEQ ID NO: 4301) |
| 50 | B | OBD159_4165 | CTATTTGCTTCCATCTCTTCTTCAAG (SEQ ID NO: 2108) | OBD159_4167 | GCCTTGAGCCAATGTTGAACCCAGTA (SEQ ID NO: 4302) |
| 51 | B | OBD159_4169 | GGTGTCAACTGTAGTGTTTCCATTTTCA (SEQ ID NO: 4252) | OBD159_4171 | CACGATGAGTATGAAGGGCAGAGCGT TT (SEQ ID NO: 4303) |

TABLE 9.2a

| No. | Group | Probe | GeneLocus | Probe_Count_Total |
|---|---|---|---|---|
| 52 | B | ORF14_1_31540047_31543886_31587537_31592007_FF | N/A | N/A |
| 53 | B | ORF119_2_218948268_218952031_218967854_218969392_RR | N/A | N/A |
| 54 | B | ORF18_2_47506510_47507935_47522457_47530546_RR | N/A | N/A |
| 55 | B | ORF18_8_22370928_22373682_22477274_22479031_FF | N/A | N/A |
| 56 | B | ORF19_21_17395228_17399850_17441050_17442330_RR | N/A | N/A |
| 57 | B | ORF163_9_127769656_127771134_127789432_127791005_RR | N/A | N/A |
| 58 | B | ORF116_2_242067121_242068527_242133611_242136266_FF | N/A | N/A |
| 59 | B | ORF17_1_81722088_81728566_81795686_81801062_FR | N/A | N/A |
| 60 | B | ORF1_2_227767541_227769435_227779837_227782633_RF | N/A | N/A |
| 61 | B | ORF12_6_489302_494492_562962_566609_FR | N/A | N/A |
| 62 | B | ORF106_7_16777840_16784530_16819587_16825123_FR | N/A | N/A |
| 63 | B | ORF19_20_38329699_38336059_38443612_38450633_RR | N/A | N/A |
| 64 | B | ORF15_16_14002832_14006140_14029360_14030604_RR | N/A | N/A |
| 65 | B | ORF13_4_125301039_125303568_125344175_125348116_FF | N/A | N/A |
| 66 | B | ORF14_6_134270140_134271366_134318303_134322289_FF | N/A | N/A |
| 67 | B | ORF158_14_73160989_73163045_73174453_73177740_RF | N/A | N/A |
| 68 | B | ORF156_13_60855031_60860383_60904843_60913572_FR | N/A | N/A |
| 69 | B | ORF1_2_28511589_28516309_28600362_28606396_RR | N/A | N/A |
| 70 | B | ORF19_6_134285274_134289662_134322425_134324942_FR | N/A | N/A |
| 71 | B | ORF145_16_14002832_14006140_14029360_14030604_RR | N/A | N/A |
| 72 | B | ORF12_15_59226397_59229578_59275124_59282145_FF | N/A | N/A |
| 73 | B | ORF127_4_87521130_87535092_87627331_87629853_FF | N/A | N/A |
| 74 | B | ORF10_8_29194737_29197133_29221895_29223912_RR | N/A | N/A |
| 75 | B | ORF102_1_91729836_91735039_91769176_91774685_FF | N/A | N/A |
| 76 | B | ORF12_8_9827711_9830539_9907504_9913050_RF | N/A | N/A |

TABLE 9.2a-continued

| No. | Group | Probe | GeneLocus | Probe_Count_Total |
|---|---|---|---|---|
| 77 | B | ORF182_5_7525226_7526562_7606244_7610178_FR | N/A | N/A |
| 78 | B | ORF11_19_10462371_10464602_10512340_10514192_FF | N/A | N/A |
| 79 | B | ORF107_5_7540900_7542383_7560907_7566450_FF | N/A | N/A |
| 80 | B | ORF19_5_53082652_53086261_53104495_53107169_RR | N/A | N/A |
| 81 | B | ORF146_7_158585412_158588279_158654906_158659127_FR | N/A | N/A |
| 82 | B | ORF10_18_23950674_23952569_24015103_24017541_RR | N/A | N/A |
| 83 | B | ORF160_6_111460815_111466030_111524702_111525757_RR | N/A | N/A |
| 84 | B | ORF14_2_24009691_24012849_24049864_24051131_FR | N/A | N/A |
| 85 | B | ORF153_7_16086203_16100539_16133512_16139722_FF | N/A | N/A |
| 86 | B | ORF140_20_57363873_57366958_57379133_57382850_RR | N/A | N/A |
| 87 | B | ORF159_2_16713427_16718029_16757015_16758385_RR | N/A | N/A |
| 88 | C | ORF19_21_41926859_41930173_41979620_41986582_RR | N/A | N/A |
| 89 | C | ORF171_4_152168385_152172738_152243834_152246201_FR | N/A | N/A |
| 90 | C | ORF14_7_22502113_22509109_22587350_22592472_RR | N/A | N/A |
| 91 | C | ORF13_12_83913616_83915585_83954032_83957600_FR | N/A | N/A |
| 92 | C | ORF104_12_82663103_82673256_82704442_82708010_RR | N/A | N/A |
| 93 | C | ORF139_14_68325745_68327713_68392804_68395555_FF | N/A | N/A |
| 94 | C | ORF15_2_41904272_41908286_41953265_41954493_RF | N/A | N/A |
| 95 | C | ORF107_10_50601158_50604736_50643028_50654450_FF | N/A | N/A |
| 96 | C | ORF131_9_111939947_111941193_112015341_112018045_FF | N/A | N/A |
| 97 | C | ORF168_3_43042539_43050797_43066697_43075829_RF | N/A | N/A |
| 98 | C | ORF13_1_83403878_83408459_83447955_83452928_FF | N/A | N/A |
| 99 | C | ORF19_20_19870175_19876327_19917735_19921318_FR | N/A | N/A |
| 100 | C | ORF105_1_197427797_197435397_197468569_197471959_RF | N/A | N/A |
| 101 | C | ORF17_3_120801777_120809148_120844722_120858831_FR | N/A | N/A |
| 102 | C | ORF16_11_47464161_47467927_47526127_47528647_FF | N/A | N/A |

TABLE 9.2b

| No. | Group | Probe_Count_Sig | HyperG_Stats | FDR_HyperG | Percent_Sig | logFC | AveExpr |
|---|---|---|---|---|---|---|---|
| 52 | B | N/A | N/A | N/A | N/A | −0.529395969 | −0.529395969 |
| 53 | B | N/A | N/A | N/A | N/A | −0.527638119 | −0.527638119 |
| 54 | B | N/A | N/A | N/A | N/A | −0.527523869 | −0.527523869 |
| 55 | B | N/A | N/A | N/A | N/A | −0.527016307 | −0.527016307 |
| 56 | B | N/A | N/A | N/A | N/A | −0.526648103 | −0.526648103 |
| 57 | B | N/A | N/A | N/A | N/A | −0.526047264 | −0.526047264 |
| 58 | B | N/A | N/A | N/A | N/A | −0.525971711 | −0.525971711 |
| 59 | B | N/A | N/A | N/A | N/A | −0.522903803 | −0.522903803 |
| 60 | B | N/A | N/A | N/A | N/A | −0.521712317 | −0.521712317 |
| 61 | B | N/A | N/A | N/A | N/A | −0.520936683 | −0.520936683 |
| 62 | B | N/A | N/A | N/A | N/A | −0.520151763 | −0.520151763 |
| 63 | B | N/A | N/A | N/A | N/A | −0.519882289 | −0.519882289 |
| 64 | B | N/A | N/A | N/A | N/A | −0.517203512 | −0.517203512 |
| 65 | B | N/A | N/A | N/A | N/A | −0.516650168 | −0.516650168 |
| 66 | B | N/A | N/A | N/A | N/A | −0.516240578 | −0.516240578 |
| 67 | B | N/A | N/A | N/A | N/A | −0.514825173 | −0.514825173 |
| 68 | B | N/A | N/A | N/A | N/A | −0.513073175 | −0.513073175 |
| 69 | B | N/A | N/A | N/A | N/A | −0.512357312 | −0.512357312 |
| 70 | B | N/A | N/A | N/A | N/A | −0.512210871 | −0.512210871 |
| 71 | B | N/A | N/A | N/A | N/A | −0.511854022 | −0.511854022 |
| 72 | B | N/A | N/A | N/A | N/A | −0.511674292 | −0.511674292 |
| 73 | B | N/A | N/A | N/A | N/A | −0.510887414 | −0.510887414 |
| 74 | B | N/A | N/A | N/A | N/A | −0.510879346 | −0.510879346 |
| 75 | B | N/A | N/A | N/A | N/A | −0.510258222 | −0.510258222 |
| 76 | B | N/A | N/A | N/A | N/A | −0.509727293 | −0.509727293 |
| 77 | B | N/A | N/A | N/A | N/A | −0.509268221 | −0.509268221 |
| 78 | B | N/A | N/A | N/A | N/A | −0.508188926 | −0.508188926 |
| 79 | B | N/A | N/A | N/A | N/A | −0.507304055 | −0.507304055 |
| 80 | B | N/A | N/A | N/A | N/A | −0.506922901 | −0.506922901 |
| 81 | B | N/A | N/A | N/A | N/A | −0.50608615 | −0.50608615 |
| 82 | B | N/A | N/A | N/A | N/A | −0.504510261 | −0.504510261 |
| 83 | B | N/A | N/A | N/A | N/A | −0.503933309 | −0.503933309 |
| 84 | B | N/A | N/A | N/A | N/A | −0.502710965 | −0.502710965 |
| 85 | B | N/A | N/A | N/A | N/A | −0.502016712 | −0.502016712 |
| 86 | B | N/A | N/A | N/A | N/A | −0.50169487 | −0.50169487 |
| 87 | B | N/A | N/A | N/A | N/A | −0.501620823 | −0.501620823 |
| 88 | C | N/A | N/A | N/A | N/A | −0.652403404 | −0.652403404 |
| 89 | C | N/A | N/A | N/A | N/A | −0.647165032 | −0.647165032 |
| 90 | C | N/A | N/A | N/A | N/A | −0.615550698 | −0.615550698 |
| 91 | C | N/A | N/A | N/A | N/A | −0.61449779 | −0.61449779 |
| 92 | C | N/A | N/A | N/A | N/A | −0.607775641 | −0.607775641 |
| 93 | C | N/A | N/A | N/A | N/A | −0.607726195 | −0.607726195 |
| 94 | C | N/A | N/A | N/A | N/A | −0.607072304 | −0.607072304 |
| 95 | C | N/A | N/A | N/A | N/A | −0.604120415 | −0.604120415 |

TABLE 9.2b-continued

| No. | Group | Probe_Count_Sig | HyperG_Stats | FDR_HyperG | Percent_Sig | logFC | AveExpr |
|---|---|---|---|---|---|---|---|
| 96 | C | N/A | N/A | N/A | N/A | −0.603262101 | −0.603262101 |
| 97 | C | N/A | N/A | N/A | N/A | −0.600843342 | −0.600843342 |
| 98 | C | N/A | N/A | N/A | N/A | −0.600791862 | −0.600791862 |
| 99 | C | N/A | N/A | N/A | N/A | −0.59994654 | −0.59994654 |
| 100 | C | N/A | N/A | N/A | N/A | −0.592026529 | −0.592026529 |
| 101 | C | N/A | N/A | N/A | N/A | −0.588268908 | −0.588268908 |
| 102 | C | N/A | N/A | N/A | N/A | −0.582205534 | −0.582205534 |

TABLE 9.2c

| No. | Group | t | P. Value | adj. P. Val | B | FC |
|---|---|---|---|---|---|---|
| 52 | B | −5.690762577 | 0.000102646 | 0.001487975 | 1.31599159 | 0.692844755 |
| 53 | B | −4.919995757 | 0.000359361 | 0.003565786 | 0.02943148 | 0.693689466 |
| 54 | B | −2.675926334 | 0.020268164 | 0.061543564 | −4.027898971 | 0.693744402 |
| 55 | B | −5.741330707 | 0.0000948 | 0.001407517 | 1.397496922 | 0.693988515 |
| 56 | B | −8.750621085 | 0.00000154 | 0.0000975 | 5.614994568 | 0.694165657 |
| 57 | B | −3.527659902 | 0.00419664 | 0.019730707 | −2.469421969 | 0.694454817 |
| 58 | B | −7.139301113 | 0.0000122 | 0.000358474 | 3.506957853 | 0.694491186 |
| 59 | B | −6.821672871 | 0.0000190 | 0.000481644 | 3.051725051 | 0.695969601 |
| 60 | B | −7.937569142 | 0.00000421 | 0.000183123 | 4.591796433 | 0.696544622 |
| 61 | B | −6.623946979 | 0.0000252 | 0.000578297 | 2.761300403 | 0.696919205 |
| 62 | B | −4.687821255 | 0.00053267 | 0.004706914 | −0.373637152 | 0.697298478 |
| 63 | B | −5.652033695 | 0.000109099 | 0.001549567 | 1.253322473 | 0.697428735 |
| 64 | B | −4.522607316 | 0.000707922 | 0.005751261 | −0.66444806 | 0.698724914 |
| 65 | B | −8.279333914 | 0.00000274 | 0.000139883 | 5.031532143 | 0.698992961 |
| 66 | B | −5.926417544 | 0.0000712 | 0.00115992 | 1.692704956 | 0.699191437 |
| 67 | B | −9.005921005 | 0.00000114 | 0.0000806 | 5.920413033 | 0.69987774 |
| 68 | B | −4.675777781 | 0.000543764 | 0.004769579 | −0.39472724 | 0.700728182 |
| 69 | B | −6.048194344 | 0.0000591 | 0.001022569 | 1.884262734 | 0.701075968 |
| 70 | B | −6.810569759 | 0.0000193 | 0.000486577 | 3.035561098 | 0.701147135 |
| 71 | B | −4.352866432 | 0.00095165 | 0.006944731 | −0.966430198 | 0.701320584 |
| 72 | B | −6.503963115 | 0.0000299 | 0.000650266 | 2.582412353 | 0.70140796 |
| 73 | B | −7.92396296 | 0.00000429 | 0.000185092 | 4.573991509 | 0.701790628 |
| 74 | B | −6.3701302 | 0.0000364 | 0.000738798 | 2.380469678 | 0.701794552 |
| 75 | B | −4.223801971 | 0.001194552 | 0.008083156 | −1.19804568 | 0.702096761 |
| 76 | B | −7.615247067 | 0.00000641 | 0.000236522 | 4.163720233 | 0.702355189 |
| 77 | B | −4.077668423 | 0.001548838 | 0.009761952 | −1.462172899 | 0.702578717 |
| 78 | B | −2.088762163 | 0.058824865 | 0.132391854 | −5.041102442 | 0.70310452 |
| 79 | B | −8.065061478 | 0.00000358 | 0.000165297 | 4.757512949 | 0.703535898 |
| 80 | B | −6.691374518 | 0.0000228 | 0.000543343 | 2.860957982 | 0.703721794 |
| 81 | B | −3.113255034 | 0.009018206 | 0.034017867 | −3.23295053 | 0.704130065 |
| 82 | B | −2.820885018 | 0.015504316 | 0.050521458 | −3.766739026 | 0.704899623 |
| 83 | B | −7.596010808 | 0.00000657 | 0.000240006 | 4.137752552 | 0.705181578 |
| 84 | B | −7.743606851 | 0.00000541 | 0.000214421 | 4.33577836 | 0.705779306 |
| 85 | B | −4.645302371 | 0.000572929 | 0.0049448 | −0.448172394 | 0.706119023 |
| 86 | B | −3.251265086 | 0.006984607 | 0.028816277 | −2.979033184 | 0.706276564 |
| 87 | B | −3.17771015 | 0.008003188 | 0.03102913 | −3.114458829 | 0.706312815 |
| 88 | C | −4.116449219 | 0.001445338 | 0.009299015 | −1.391897027 | 0.636219544 |
| 89 | C | −5.250916799 | 0.00020771 | 0.002439261 | 0.591815066 | 0.638533832 |
| 90 | C | −8.077603511 | 0.00000353 | 0.000163777 | 4.77370666 | 0.652680708 |
| 91 | C | −7.031456546 | 0.0000141 | 0.000395406 | 3.353937492 | 0.653157222 |
| 92 | C | −6.824378577 | 0.0000189 | 0.000480364 | 3.055661441 | 0.656207669 |
| 93 | C | −4.680678233 | 0.000539221 | 0.004740769 | −0.386143641 | 0.65623016 |
| 94 | C | −4.417314421 | 0.000850172 | 0.006506693 | −0.851406678 | 0.656527658 |
| 95 | C | −3.68903726 | 0.003123853 | 0.015776466 | −2.17232846 | 0.657872351 |
| 96 | C | −3.095886903 | 0.00931321 | 0.034876334 | −3.264843305 | 0.65826386 |
| 97 | C | −5.867551598 | 0.0000779 | 0.001234191 | 1.599346596 | 0.659368402 |
| 98 | C | −5.934080716 | 0.0000703 | 0.001151203 | 1.70482188 | 0.659391931 |
| 99 | C | −6.624898406 | 0.0000251 | 0.000578066 | 2.762719907 | 0.659778403 |
| 100 | C | −8.923879856 | 0.00000126 | 0.0000857 | 5.823061426 | 0.663410371 |
| 101 | C | −3.189650431 | 0.007828185 | 0.030504397 | −3.092488015 | 0.665140532 |
| 102 | C | −8.509149731 | 0.00000206 | 0.000117329 | 5.319296317 | 0.667941874 |

TABLE 9.2d

| No. | Group | FC_1 | LS | Loop Detected |
|---|---|---|---|---|
| 52 | B | −1.443324775 | −1 | Mild Autism |
| 53 | B | −1.441567228 | −1 | Mild Autism |
| 54 | B | −1.441453072 | −1 | Mild Autism |
| 55 | B | −1.440946036 | −1 | Mild Autism |
| 56 | B | −1.440578326 | −1 | Mild Autism |

TABLE 9.2d-continued

| No. | Group | FC_1 | LS | Loop Detected |
|---|---|---|---|---|
| 57 | B | −1.439978492 | −1 | Mild Autism |
| 58 | B | −1.439903084 | −1 | Mild Autism |
| 59 | B | −1.436844367 | −1 | Mild Autism |
| 60 | B | −1.435658203 | −1 | Mild Autism |
| 61 | B | −1.434886559 | −1 | Mild Autism |

TABLE 9.2d-continued

| No. | Group | FC_1 | LS | Loop Detected |
|---|---|---|---|---|
| 62 | B | −1.4341061 | −1 | Mild Autism |
| 63 | B | −1.433838255 | −1 | Mild Autism |
| 64 | B | −1.431178393 | −1 | Mild Autism |
| 65 | B | −1.430629572 | −1 | Mild Autism |
| 66 | B | −1.430223465 | −1 | Mild Autism |
| 67 | B | −1.428820983 | −1 | Mild Autism |
| 68 | B | −1.427086887 | −1 | Mild Autism |
| 69 | B | −1.426378945 | −1 | Mild Autism |
| 70 | B | −1.426234167 | −1 | Mild Autism |
| 71 | B | −1.425881434 | −1 | Mild Autism |
| 72 | B | −1.425703809 | −1 | Mild Autism |
| 73 | B | −1.42492641 | −1 | Mild Autism |
| 74 | B | −1.424918442 | −1 | Mild Autism |
| 75 | B | −1.424305103 | −1 | Mild Autism |
| 76 | B | −1.423781038 | −1 | Mild Autism |
| 77 | B | −1.423328057 | −1 | Mild Autism |
| 78 | B | −1.422263649 | −1 | Mild Autism |
| 79 | B | −1.421391577 | −1 | Mild Autism |
| 80 | B | −1.4210161 | −1 | Mild Autism |
| 81 | B | −1.420192163 | −1 | Mild Autism |
| 82 | B | −1.418641701 | −1 | Mild Autism |

TABLE 9.2d-continued

| No. | Group | FC_1 | LS | Loop Detected |
|---|---|---|---|---|
| 83 | B | −1.418074481 | −1 | Mild Autism |
| 84 | B | −1.416873507 | −1 | Mild Autism |
| 85 | B | −1.416191843 | −1 | Mild Autism |
| 86 | B | −1.415875949 | −1 | Mild Autism |
| 87 | B | −1.41580328 | −1 | Mild Autism |
| 88 | B | −1.571784471 | −1 | Mild Autism |
| 89 | B | −1.56608773 | −1 | Mild Autism |
| 90 | B | −1.532142727 | −1 | Mild Autism |
| 91 | B | −1.531024946 | −1 | Mild Autism |
| 92 | B | −1.523907823 | −1 | Mild Autism |
| 93 | B | −1.523855594 | −1 | Mild Autism |
| 94 | B | −1.523165075 | −1 | Mild Autism |
| 95 | B | −1.520051723 | −1 | Mild Autism |
| 96 | B | −1.519147656 | −1 | Mild Autism |
| 97 | B | −1.516602853 | −1 | Mild Autism |
| 98 | B | −1.516548737 | −1 | Mild Autism |
| 99 | B | −1.515660402 | −1 | Mild Autism |
| 100 | B | −1.507362628 | −1 | Mild Autism |
| 101 | B | −1.503441682 | −1 | Mild Autism |
| 102 | B | −1.497136261 | −1 | Mild Autism |

TABLE 9.2e

| No. | Group | Probe sequence 60 mer | Probe Location Chr |
|---|---|---|---|
| 52 | B | TTTTTGTATTTTTAATAGAGAAATGGCCTCGAAGGAGCTAAAGTGAGTGAAGCACATAGT (SEQ ID NO: 4304) | 1 |
| 53 | B | TTTTCTTTCTTTCATTTTTTTTTTTTTTTCGACTTAATAGACTCCTCCTTCTCATCATCA (SEQ ID NO: 4305) | 2 |
| 54 | B | AGCAAAAAGTGAAGACTGCTTGACTTTTTCGAAAAGGCCTTTGGTCAAACGATCATATTT (SEQ ID NO: 4306) | 2 |
| 55 | B | TATAAGACAGTAATTTCAGAATTACTGTTCGATAGATCTCATACTTTGGTTTTAACACTG (SEQ ID NO: 4307) | 8 |
| 56 | B | TAGTGTTTGATAACACAGGGAAAGTCTTTCGAAGTATTACTATTCTCACTTTATAGATGA (SEQ ID NO: 4308) | 21 |
| 57 | B | TTTTCTTTATTTCTTTTTTTTTTTTTTTTCGAGTACTTGGCACCACCGCGCCGGAAGGGC (SEQ ID NO: 4309) | 9 |
| 58 | B | GATGTCTGTAATTTATTCAAAGATTCTCTCGAAGAAAAAGCAATAAGAAGCCTCAGCAA (SEQ ID NO: 4310) | 2 |
| 59 | B | TAACTCATAGTCTAATACATAAGCACAATCGAGAGGCACTAAAAATTCAATTTGGACTAT (SEQ ID NO: 4311) | 1 |
| 60 | B | GCATTGTTTCTTCATTTTATTTTATTTTTCGATCAGTCATAATCAGTCAATCATGGCAGT (SEQ ID NO: 4312) | 2 |
| 61 | B | AATGTACATACTACACAACAGACAAATCTCGATGAAAGTAGGCAAAGAATATAATTTTGG (SEQ ID NO: 4313) | 6 |
| 62 | B | AATTAAAAGAAAGTAATGGAAGAATTGATCGACTTTTATAAACGGGGGCACGTGTTCAGG (SEQ ID NO: 4314) | 7 |
| 63 | B | AAAAAAATAAATAAAATAAAGCAGGGTTTCGAATAAAATAAAATTAGGGCCAGGCATGAT (SEQ ID NO: 4315) | 20 |
| 64 | B | TCTTAATTTGATTTTCTCTGGCTCAGAATCGAGATATTACACTCCAGCCTGGGTGACGGA (SEQ ID NO: 4316) | 16 |
| 65 | B | TCTTTACTAAAGAGAATCTATCTTGTATTCGAGGTTCAGAAATATTGTGCAACTTTTACA (SEQ ID NO: 4317) | 4 |
| 66 | B | CATTCTTTTCGTTTGAATTTGTCTTTCCTCGAAAAAAAATTACATTCCATTCAACAACTAA (SEQ ID NO: 4318) | 6 |
| 67 | B | TCCATGGTTTCTCATAAAAATCAGTCATTCGATACAAGGTTTTACTGTGTCACCCAGGCT (SEQ ID NO: 4319) | 14 |
| 68 | B | AACTCATACATTATCTATTTACTGAAAATCGATAGATGCAGAAAAGGTCTTCAATAAAAT | 13 |

TABLE 9.2e-continued

| No. | Group | Probe sequence 60 mer | Probe Location Chr |
|-----|-------|----------------------|---------------------|
|     |       | (SEQ ID NO: 4320) |   |
| 69 | B | ATTTTGAAAGCAGCAGGAGTAAAACTCTTCGATATGAACATTTTTACGGTTATTATGTTT <br> (SEQ ID NO: 4321) | 2 |
| 70 | B | GGTATGTATTTTACATCTAAAGTACATCTCGATCATATGCTTAAAACTCCAGCCACAGTG <br> (SEQ ID NO: 4322) | 6 |
| 71 | B | TCTTAATTTGATTTTCTCTGGCTCAGAATCGAGATATTACACTCCAGCCTGGGTGACGGA <br> (SEQ ID NO: 4316) | 16 |
| 72 | B | TGATAATGAAATGAAAGAAGTTTCACCTCGAACAGAAGTTATTTAAATTCCCTATGGCT <br> (SEQ ID NO: 4324) | 15 |
| 73 | B | CTAAATTCCAAATCTCATTTAAATACCATCGATCTGTTTTAACTTTTTAAAATTTTGCAA <br> (SEQ ID NO: 4325) | 4 |
| 74 | B | TGATTTTTCCTTTATGCTTCTATGTTATTCGATACTTTATAAAATGAAAAACCTCTTCTT <br> (SEQ ID NO: 4326) | 8 |
| 75 | B | ATCATAATTAGAGAAAGTACTTCTCAAATCGATTGTGATGACCGAGACTTGTTCTCAGAC <br> (SEQ ID NO: 4327) | 1 |
| 76 | B | TTCTCTGTTTAATATATATATTTTTTCTTCGAATCGCAATAACAGCAAACAATACAGGTT <br> (SEQ ID NO: 4328) | 8 |
| 77 | B | TTTAATCATTACACCTTGTAAACAAGTATCGATAAAAATGTACTTCAAAAATTGGATTGG <br> (SEQ ID NO: 4329) | 5 |
| 78 | B | CACCTAGCTAATTTTTTAAAATTTTTTGTCGACGTGGCGTGCCCGGCGCGCACCTGTCCT <br> (SEQ ID NO: 4330) | 19 |
| 79 | B | TATTACAGAAAAAAAAAAAATGGATCTCTTCGATCGTATCTCACTGGAGCTTCAAACTCCT <br> (SEQ ID NO: 4331) | 5 |
| 80 | B | TTGATAATGATATAGTAATGTAGTTTCATCGAAATTCCAAAAAACTGCATTTTTAGAACC <br> (SEQ ID NO: 4332) | 5 |
| 81 | B | GGCCTCTACCCGCGGGGCCCCGCGCGCGTCGAACACCTCTTATATGTAATGTATAAAATT <br> (SEQ ID NO: 4333) | 7 |
| 82 | B | AAAATGGCATATTATATCAATCTTTCACTCGACCTGCGGCCCCCGGGAGCCCCCTCCCCC <br> (SEQ ID NO: 4334) | 18 |
| 83 | B | GGACCACCATTATATATGTGGTCCCTTGTCGAACTATGCTCTATGTTCTTTTAGATGCAA <br> (SEQ ID NO: 4335) | 6 |
| 84 | B | GTAAATGAGCTATCGCCTCATTTACTCATCGAGACCATCTCCCCCGGAGACGGTACCGGG <br> (SEQ ID NO: 4336) | 2 |
| 85 | B | TAGCTTACCTTAAGATATCTTTGAAATATCGATTTTTCTTGGGTTTACTATATACCAGGC <br> (SEQ ID NO: 4337) | 7 |
| 86 | B | TTAATCTAGTCATCACAATTTTCCACTATCGATAGTGTTGTAAGATGTGTTTGCCTACTC <br> (SEQ ID NO: 4338) | 20 |
| 87 | B | AAACATGAAAGAAAGTAAACATGAAAAATCGAGTTCACAGCTGTGGAAAGAAACTTCACG <br> (SEQ ID NO: 4339) | 2 |
| 88 | C | TACAGAATGTGATGAAAGTGAAAATTATTCGATCTGCTGGAATCATGAAAGTCTAAATTT <br> (SEQ ID NO: 4340) | 21 |
| 89 | C | AAACTTTAAAACAAAATGAAGTTCTAATTCGAACATTCAAATTCCCTAAAGAAAGAGAG <br> (SEQ ID NO: 4341) | 4 |
| 90 | C | AAGCTTTTTAGTAACATGTTTTTCTTAATCGAATGGTCTGTTCAAGACTATTTTATAGTG <br> (SEQ ID NO: 4342) | 7 |
| 91 | C | AGATTAGTTTCTTATGACATATTCATAGTCGAGATAGAGTATGTAATCATTTTATGATTT <br> (SEQ ID NO: 4343) | 12 |
| 92 | C | TGAGACTAGAGTTATTTTCATCTGATTCTCGAATGTAGCTTACCTACTGCATTTGAAGAA <br> (SEQ ID NO: 4344) | 12 |
| 93 | C | TCTAACCATTATGAGTAGATATTAATCTTCGAGAGCATAAAAATTTCCTTAAACTGATCA <br> (SEQ ID NO: 4345) | 14 |

TABLE 9.2e-continued

| No. | Group | Probe sequence 60 mer | Probe Location Chr |
|-----|-------|------------------------|--------------------|
| 94 | C | TTCATATTTAGGCAGAAAAAAACAGCTTTCGAAGACCAGGACAAGGTACTGTCCCGGAAC (SEQ ID NO: 4346) | 2 |
| 95 | C | CTATTTAAATCAAGGACTTAAAAAGTCCTCGACAAGAGGTATGAAGGTTGAGACCTCTCT (SEQ ID NO: 4347) | 10 |
| 96 | C | ATATATGGCTTTTTAATGGCTGGTAAGATCGACATAAGGATATATAGATCAGAGAAACAT (SEQ ID NO: 4348) | 9 |
| 97 | C | AAAATGTTAATTAGAATTTATTTGGCTTTCGAATGCCTTTTGGGTATCTGTGGGAGAAGT (SEQ ID NO: 4349) | 3 |
| 98 | C | AGGAAAAATATATAGCTAAAGATGTCTCTCGAGGTACTCCAGTTTTTTATTTTTATAATA (SEQ ID NO: 4350) | 1 |
| 99 | C | ATCTTCAGGTCGTATAAATCTTTTGCCTTCGATATATACTGTACATCTCAAGAAATATGT (SEQ ID NO: 4351) | 20 |
| 100 | C | TTTTTTAAAAAAGTTAGTGGATGAGCATTCGAAAAGGGAGATGTCATCTACATTGGTGGC (SEQ ID NO: 4352) | 1 |
| 101 | C | AGATTCTGTGTGTTGCCAGAATCACAACTCGAATGCCTAAAAAGCCTTTATTCTTATAAA (SEQ ID NO: 4353) | 3 |
| 102 | C | AAAACAGCTTCTTTGAAACCCTTTTAAATCGACCTCCCAATTTTTATTTTTATTTTTTTA (SEQ ID NO: 4354) | 11 |

TABLE 9.2f

| | | Probe Location | | | | 4 kb Sequence Location | |
|-----|-------|--------|------|--------|------|-----|--------|
| No. | Group | Start1 | End1 | Start2 | End2 | Chr | Start1 |
| 52 | B | 31543855 | 31543884 | 31591976 | 31592005 | 1 | 31539885 |
| 53 | B | 218948270 | 218948299 | 218967856 | 218967885 | 2 | 218948270 |
| 54 | B | 47506512 | 47506541 | 47522459 | 47522488 | 2 | 47506512 |
| 55 | B | 22373651 | 22373680 | 22479000 | 22479029 | 8 | 22369681 |
| 56 | B | 17395230 | 17395259 | 17441052 | 17441081 | 21 | 17395230 |
| 57 | B | 127769658 | 127769687 | 127789434 | 127789463 | 9 | 127769658 |
| 58 | B | 242068496 | 242068525 | 242136235 | 242136264 | 2 | 242064526 |
| 59 | B | 81728535 | 81728564 | 81795688 | 81795717 | 1 | 81724565 |
| 60 | B | 227767543 | 227767572 | 227782602 | 227782631 | 2 | 227767543 |
| 61 | B | 494461 | 494490 | 562964 | 562993 | 6 | 490491 |
| 62 | B | 16784499 | 16784528 | 16819589 | 16819618 | 7 | 16780529 |
| 63 | B | 38329701 | 38329730 | 38443614 | 38443643 | 20 | 38329701 |
| 64 | B | 14002834 | 14002863 | 14029362 | 14029391 | 16 | 14002834 |
| 65 | B | 125303537 | 125303566 | 125348085 | 125348114 | 4 | 125299567 |
| 66 | B | 134271335 | 134271364 | 134322258 | 134322287 | 6 | 134267365 |
| 67 | B | 73160991 | 73161020 | 73177709 | 73177738 | 14 | 73160991 |
| 68 | B | 60860352 | 60860381 | 60904845 | 60904874 | 13 | 60856382 |
| 69 | B | 28511591 | 28511620 | 28600364 | 28600393 | 2 | 28511591 |
| 70 | B | 134289631 | 134289660 | 134322427 | 134322456 | 6 | 134285661 |
| 71 | B | 14002834 | 14002863 | 14029362 | 14029391 | 16 | 14002834 |
| 72 | B | 59229547 | 59229576 | 59282114 | 59282143 | 15 | 59225577 |
| 73 | B | 87535061 | 87535090 | 87629822 | 87629851 | 4 | 87531091 |
| 74 | B | 29194739 | 29194768 | 29221897 | 29221926 | 8 | 29194739 |
| 75 | B | 91735008 | 91735037 | 91774654 | 91774683 | 1 | 91731038 |
| 76 | B | 9827713 | 9827742 | 9913019 | 9913048 | 8 | 9827713 |
| 77 | B | 7526531 | 7526560 | 7606246 | 7606275 | 5 | 7522561 |
| 78 | B | 10464571 | 10464600 | 10514161 | 10514190 | 19 | 10460601 |
| 79 | B | 7542352 | 7542381 | 7566419 | 7566448 | 5 | 7538382 |
| 80 | B | 53082654 | 53082683 | 53104497 | 53104526 | 5 | 53082654 |
| 81 | B | 158588248 | 158588277 | 158654908 | 158654937 | 7 | 158584278 |
| 82 | B | 23950676 | 23950705 | 24015105 | 24015134 | 18 | 23950676 |
| 83 | B | 111460817 | 111460846 | 111524704 | 111524733 | 6 | 111460817 |
| 84 | B | 24012818 | 24012847 | 24049866 | 24049895 | 2 | 24008848 |
| 85 | B | 16100508 | 16100537 | 16139691 | 16139720 | 7 | 16096538 |
| 86 | B | 57363875 | 57363904 | 57379135 | 57379164 | 20 | 57363875 |
| 87 | B | 16713429 | 16713458 | 16757017 | 16757046 | 2 | 16713429 |
| 88 | C | 41926861 | 41926890 | 41979622 | 41979651 | 21 | 41926861 |
| 89 | C | 152172707 | 152172736 | 152243836 | 152243865 | 4 | 152168737 |
| 90 | C | 22502115 | 22502144 | 22587352 | 22587381 | 7 | 22502115 |
| 91 | C | 83915554 | 83915583 | 83954034 | 83954063 | 12 | 83911584 |
| 92 | C | 82663105 | 82663134 | 82704444 | 82704473 | 12 | 82663105 |

TABLE 9.2f-continued

| No. | Group | Start1 | End1 | Start2 | End2 | Chr | Start1 |
|-----|-------|--------|------|--------|------|-----|--------|
| | | Probe Location | | | | 4 kb Sequence Location | |
| 93 | C | 68327682 | 68327711 | 68395524 | 68395553 | 14 | 68323712 |
| 94 | C | 41904274 | 41904303 | 41954462 | 41954491 | 2 | 41904274 |
| 95 | C | 50604705 | 50604734 | 50654419 | 50654448 | 10 | 50600735 |
| 96 | C | 111941162 | 111941191 | 112018014 | 112018043 | 9 | 111937192 |
| 97 | C | 43042541 | 43042570 | 43075798 | 43075827 | 3 | 43042541 |
| 98 | C | 83408428 | 83408457 | 83452897 | 83452926 | 1 | 83404458 |
| 99 | C | 19876296 | 19876325 | 19917737 | 19917766 | 20 | 19872326 |
| 100 | C | 197427799 | 197427828 | 197471928 | 197471957 | 1 | 197427799 |
| 101 | C | 120809117 | 120809146 | 120844724 | 120844753 | 3 | 120805147 |
| 102 | C | 47467896 | 47467925 | 47528616 | 47528645 | 11 | 47463926 |

TABLE 9.2g

| No. | Group | End1 | Start2 | End2 | Probe |
|-----|-------|------|--------|------|-------|
| | | 4 kb Sequence Location | | | |
| 52 | B | 31543884 | 31588006 | 31592005 | ORF14_1_31540047_31543886_31587537_31592007_FF |
| 53 | B | 218952269 | 218967856 | 218971855 | ORF119_2_218948268_218952031_218967854_218969392_RR |
| 54 | B | 47510511 | 47522459 | 47526458 | ORF18_2_47506510_47507935_47522457_47530546_RR |
| 55 | B | 22373680 | 22475030 | 22479029 | ORF18_8_22370928_22373682_22477274_22479031_FF |
| 56 | B | 17399229 | 17441052 | 17445051 | ORF19_21_17395228_17399850_17441050_17442330_RR |
| 57 | B | 127773657 | 127789434 | 127793433 | ORF163_9_127769656_127771134_127789432_127791005_RR |
| 58 | B | 242068525 | 242132265 | 242136264 | ORF116_2_242067121_242068527_242133611_242136266_FF |
| 59 | B | 81728564 | 81795688 | 81799687 | ORF17_1_81722088_81728566_81795686_81801062_FR |
| 60 | B | 227771542 | 227778632 | 227782631 | ORF1_2_227767541_227769435_227779837_227782633_RF |
| 61 | B | 494490 | 562964 | 566963 | ORF12_6_489302_494492_562962_566609_FR |
| 62 | B | 16784528 | 16819589 | 16823588 | ORF106_7_16777840_16784530_16819587_16825123_FR |
| 63 | B | 38333700 | 38443614 | 38447613 | ORF19_20_38329699_38336059_38443612_38450633_RR |
| 64 | B | 14006833 | 14029362 | 14033361 | ORF15_16_14002832_14006140_14029360_14030604_RR |
| 65 | B | 125303566 | 125344115 | 125348114 | ORF13_4_125301039_125303568_125344115_125348116_FF |
| 66 | B | 134271364 | 134318288 | 134322287 | ORF14_6_134270140_134271366_134318303_134322289_FF |
| 67 | B | 73164990 | 73173739 | 73177738 | ORF158_14_73160989_73163045_73174453_73177740_RF |
| 68 | B | 60860381 | 60904845 | 60908844 | ORF156_13_60855031_60860383_60904843_60913572_FR |
| 69 | B | 28515590 | 28600364 | 28604363 | ORF1_2_28511589_28516309_28600362_28606396_RR |
| 70 | B | 134289660 | 134322427 | 134326426 | ORF19_6_134285274_134289662_134322425_134324942_FR |
| 71 | B | 14006833 | 14029362 | 14033361 | ORF145_16_14002832_14006140_14029360_14030604_RR |
| 72 | B | 59229576 | 59278144 | 59282143 | ORF12_15_59226397_59229578_59275124_59282145_FF |
| 73 | B | 87535090 | 87625852 | 87629851 | ORF127_4_87521130_87535092_87627331_87629853_FR |
| 74 | B | 29198738 | 29221897 | 29225896 | ORF10_8_29194737_29197133_29221895_29223912_RR |
| 75 | B | 91735037 | 91770684 | 91774683 | ORF102_1_91729836_91735039_91769176_91774685_FF |
| 76 | B | 9831712 | 9909049 | 9913048 | ORF12_8_9827711_9830539_9907504_9913050_RF |
| 77 | B | 7526560 | 7606246 | 7610245 | ORF182_5_7525226_7526562_7606244_7610178_FR |
| 78 | B | 10464600 | 10510191 | 10514190 | ORF11_19_10462371_10464602_10512340_10514192_FF |
| 79 | B | 7542381 | 7562449 | 7566448 | ORF107_5_7540900_7542383_7560907_7566450_FF |
| 80 | B | 53086653 | 53104497 | 53108496 | ORF19_5_53082652_53086261_53104495_53107169_RR |
| 81 | B | 158588277 | 158654908 | 158658907 | ORF146_7_158585412_158588279_158654906_158659127_FR |
| 82 | B | 23954675 | 24015105 | 24019104 | ORF10_18_23950674_23954675_24015103_24017541_RR |
| 83 | B | 111464816 | 111524704 | 111528703 | ORF160_6_111460815_111466030_111524702_111525757_RR |
| 84 | B | 24012847 | 24049866 | 24053865 | ORF14_2_24009691_24012849_24049864_24051131_FR |
| 85 | B | 16100537 | 16135721 | 16139720 | ORF153_7_16086203_16100539_16133512_16139722_FF |
| 86 | B | 57367874 | 57379135 | 57383134 | ORF140_20_57363873_57366958_57379133_57382406_RR |
| 87 | B | 16717428 | 16757017 | 16761016 | ORF159_2_16713427_16718029_16757015_16758385_RR |
| 88 | C | 41930860 | 41979622 | 41983621 | ORF19_21_41926859_41930173_41979620_41986582_RR |
| 89 | C | 152172736 | 152243836 | 152247835 | ORF171_4_152168385_152172738_152243834_152246201_FR |
| 90 | C | 22506114 | 22587352 | 22591351 | ORF14_7_22502113_22506109_22587350_22592472_RR |
| 91 | C | 83915583 | 83954034 | 83958033 | ORF13_12_83913616_83915585_83954032_83957600_FR |
| 92 | C | 82667104 | 82704444 | 82708443 | ORF104_12_82663103_82673256_82704442_82708010_RR |
| 93 | C | 68327711 | 68391554 | 68395553 | ORF139_14_68325745_68327713_68392804_68395555_FF |
| 94 | C | 41908273 | 41950492 | 41954491 | ORF15_2_41904272_41908286_41953265_41954493_RF |
| 95 | C | 50604734 | 50650449 | 50654448 | ORF107_10_50601158_50604736_50643028_50654450_FF |
| 96 | C | 111941191 | 112014044 | 112018043 | ORF131_9_111939947_111941193_112015341_112018045_FF |
| 97 | C | 43046540 | 43071828 | 43075827 | ORF168_3_43042539_43050797_43066697_43075829_RF |
| 98 | C | 83408457 | 83448927 | 83452926 | ORF13_1_83403878_83408459_83447955_83452928_FF |
| 99 | C | 19876325 | 19917737 | 19921736 | ORF19_20_19870175_19876327_19917735_19921318_FR |
| 100 | C | 197431798 | 197467958 | 197471957 | ORF105_1_197427797_197435397_197468569_197471959_RF |
| 101 | C | 120809146 | 120844724 | 120848723 | ORF17_3_120801777_120809148_120844722_120858831_FR |
| 102 | C | 47467925 | 47524646 | 47528645 | ORF16_11_47464161_47467927_47526127_47528647_FF |

TABLE 9.2h

| No. | PCR-GroupPrimer1_ID | PCR_Primer1 | PCR-Primer2_ID | PCR_Primer2 |
|---|---|---|---|---|
| 52 B | OBD159_4173 | AACAATGAAAAAAAAAGGTGTTTTT (SEQ ID NO: 4355) | OBD159_4175 | AATGAATGCCCAAGTGAAATA (SEQ ID NO: 4406) |
| 53 B | OBD159_4177 | CAGTGGAGTTGCTGGGTTATTGGGTA (SEQ ID NO: 4356) | OBD159_4179 | ATGTGATTGAGGGTAACTGTGGGACA (SEQ ID NO: 4407) |
| 54 B | OBD159_4181 | CCACTGGCATCTCCTCCCTGTTC (SEQ ID NO: 4357) | OBD159_4183 | GCAGTCCTATCACTTGGGAGGCT (SEQ ID NO: 4408) |
| 55 B | OBD159_4185 | GTCTTTTACTTCAGGGACCCCAGGTGTC (SEQ ID NO: 4358) | OBD159_4187 | GCCAACTTTATGGGCAGGCTGTGAGAAT (SEQ ID NO: 4409) |
| 56 B | OBD159_4189 | GAAAGCCTCTAACAGTGTCTGGAAGT (SEQ ID NO: 4359) | OBD159_4191 | GGATACTAACTGTGCTACTTTGGAGC (SEQ ID NO: 3130) |
| 57 B | OBD159_4193 | CAGGCGAGGGTCCCACCAGGCAT (SEQ ID NO: 4360) | OBD159_4195 | GCGACTCTGGTTGGTGGACTGCTGGGTG (SEQ ID NO: 4411) |
| 58 B | OBD159_4197 | ACTGTGGCCATGAATGGCCCACATT (SEQ ID NO: 4361) | OBD159_4199 | AATTTTGGGGTTTATATTTTTGAAAG (SEQ ID NO: 4412) |
| 59 B | OBD159_4201 | GAGAAGCCACTAAGCCTACTTTACCTCA (SEQ ID NO: 4362) | OBD159_4203 | GCACACAAACCTCCACCACTGTCAACGA (SEQ ID NO: 4413) |
| 60 B | OBD159_4205 | CAGTCCCCAGTCTTCCTTGTCCC (SEQ ID NO: 4363) | OBD159_4207 | TGTAACTCTCCCCAGGTCACTGC (SEQ ID NO: 4414) |
| 61 B | OBD159_4209 | GGCTTCCATCCGTCACTCAGTCCTGTAG (SEQ ID NO: 4364) | OBD159_4211 | GGTTTGAGCAGGTGGCATTCCCTTAGCC (SEQ ID NO: 4415) |
| 62 B | OBD159_4213 | GTAACAGCAACTTGTCAAACCTAAGCAT (SEQ ID NO: 4365) | OBD159_4215 | GAGCACGCACAGACATAAAGATGGGAA (SEQ ID NO: 4416) |
| 63 B | OBD159_4217 | CAGCTACACGGGAGGCTGAGGCAG (SEQ ID NO: 4366) | OBD159_4219 | ACTCGGGAGACGGAGGTTGCAGTGA (SEQ ID NO: 4417) |
| 64 B | OBD159_4221 | CCATTCCTTCCTCCCCACCGAGA (SEQ ID NO: 4367) | OBD159_4223 | TGCCATTAGTGAGCACCTCTGGG (SEQ ID NO: 4418) |
| 65 B | OBD159_4225 | TGTGTGTGTGTTCACTATTTCTGACTCA (SEQ ID NO: 4368) | OBD159_4227 | CTATTATTTGGGATGTCTGGAGTTGAAA (SEQ ID NO: 4419) |
| 66 B | OBD159_4229 | GTGGGACTCTGCCAGGTGCGGTGG (SEQ ID NO: 4369) | OBD159_4231 | CAAGTTCCCTCAACGCACTAAGCCTCAG (SEQ ID NO: 4420) |
| 67 B | OBD159_4233 | CCCCTTAGGATGTTTTAATTTTACC (SEQ ID NO: 4370) | OBD159_4235 | GTATTTTTTGTAGAGACGGAGTTTC (SEQ ID NO: 4421) |
| 68 B | OBD159_4237 | CTCCCACCTGCCCAGCCTTCAGAGGTT (SEQ ID NO: 4371) | OBD159_4239 | GAAAACCAGCACAAGACAAGGATG (SEQ ID NO: 4422) |
| 69 B | OBD159_4241 | GATTCAACAAGCTGAAAGAACG (SEQ ID NO: 4372) | OBD159_4243 | TACAGCTGTAGGACAAACACATCAT (SEQ ID NO: 4423) |
| 70 B | OBD159_4245 | GGATAAGCCTTTACTACTCAGGAAGTGT (SEQ ID NO: 4373) | OBD159_4247 | CCCATAATCCCCAGCAGGGTTTCCTAAT (SEQ ID NO: 4424) |
| 71 B | OBD159_4249 | CCATTCCTTCCTCCCCACCGAGA (SEQ ID NO: 4367) | OBD159_4251 | TGCCATTAGTGAGCACCTCTGGG (SEQ ID NO: 4418) |
| 72 B | OBD159_4253 | CCCAGGAAGGGCAGGTGTTGGACAGGC (SEQ ID NO: 4375) | OBD159_4255 | GGACACACTGGCATTCCCTATTGGGC (SEQ ID NO: 4426) |
| 73 B | OBD159_4257 | CCACACGCAGAATACATCCATCCCAT (SEQ ID NO: 4376) | OBD159_4259 | CCTACAAGGATTCTGTCTGACCCTGA (SEQ ID NO: 4427) |
| 74 B | OBD159_4261 | GAGGCTGGAGGTTGCAGTGAAGATA (SEQ ID NO: 4377) | OBD159_4263 | CTATATATGCCAGGCACAGTGGCTCCCGA (SEQ ID NO: 4428) |
| 75 B | OBD159_4265 | TGGACCACAGAACCCTCAGACACCTA (SEQ ID NO: 4378) | OBD159_4267 | CACTGTCAGGTTCTCAAATGCCGTTT (SEQ ID NO: 4429) |
| 76 B | OBD159_4269 | CGCCCTGCTTGGCAAAGATGTTCCCTGG (SEQ ID NO: 4379) | OBD159_4271 | GGGCAACTCGCTTACCCACTCTGTGC (SEQ ID NO: 4430) |
| 77 B | OBD159_4273 | CCAGTGTTCGGTAGTATGGTAGGGAA (SEQ ID NO: 4380) | OBD159_4275 | GGACATAAGCCCAAACAGGAACACTG (SEQ ID NO: 1880) |

TABLE 9.2h-continued

| No. | PCR-GroupPrimer1_ID | PCR_Primer1 | PCR-Primer2_ID | PCR_Primer2 |
|---|---|---|---|---|
| 78 B | OBD159_4277 | GCCCAGGGTAGCATGCAGTGGTGT (SEQ ID NO: 4381) | OBD159_4279 | CAGAGACCCGAGTGGCTCCCAGCAG (SEQ ID NO: 4432) |
| 79 B | OBD159_4281 | CCTACTCTCCTGATGTTCCAAATGGTCC (SEQ ID NO: 4382) | OBD159_4283 | GGAGCAAGGGAAACGGCTACACAGATGT (SEQ ID NO: 4433) |
| 80 B | OBD159_4285 | GGGCGGGCAGGATGAATAAGCAGAGC (SEQ ID NO: 4383) | OBD159_4287 | TAAAGAAAGGAGCAAGCCAAGGATGCCT (SEQ ID NO: 4434) |
| 81 B | OBD159_4289 | TCCCTTCCCTCCCCACTCGCAGG (SEQ ID NO: 4384) | OBD159_4291 | CTGCTCAGAAGGAAAGGTGTATTTGTCC (SEQ ID NO: 4435) |
| 82 B | OBD159_4293 | TGGGCTACCAGAGACCTACTCAGACTTA (SEQ ID NO: 4385) | OBD159_4295 | CGGGAGGGAAAGGACAACGGAGCCG (SEQ ID NO: 4436) |
| 83 B | OBD159_4297 | CTGCCATCTCCTATGATAACAGTTCCT (SEQ ID NO: 4386) | OBD159_4299 | GCTGGTTGCTGTGAACTACTTTGCTCCA (SEQ ID NO: 4437) |
| 84 B | OBD159_4301 | GGAGGGCTGTGGGTAGGCAGGCT (SEQ ID NO: 4387) | OBD159_4303 | ACCCTCCACGCCACCTCCGAATCAGACC (SEQ ID NO: 4279) |
| 85 B | OBD159_4305 | ACTAAAAGATAACTTTTCCAAATT (SEQ ID NO: 4388) | OBD159_4307 | AAAAACTCATTATATAAAGTITTAA (SEQ ID NO: 4439) |
| 86 B | OBD159_4309 | GGCTCCATCACCAGGAAGGTCTG (SEQ ID NO: 4389) | OBD159_4311 | CTGGAGAGTGGGTGGGTCTGAAT (SEQ ID NO: 4440) |
| 87 B | OBD159_4313 | GCTTCTCCCACACTCCAGGTCAT (SEQ ID NO: 4390) | OBD159_4315 | TCATTCCTGCCCTGTGGTCCCCA (SEQ ID NO: 4441) |
| 88 C | OBD159_3401 | TTGGGAGTTCTTTCCTTGGGTGTTAC (SEQ ID NO: 4391) | OBD159_3403 | TCAAGTCCGTGACACCTGTGGTTTGC (SEQ ID NO: 4442) |
| 89 C | OBD159_3509 | CACATAGTTGCTTCTCTTCAAGGTGT (SEQ ID NO: 1175) | OBD159_3511 | AAAAGCACACCCAGAATGGCTCCCAC (SEQ ID NO: 4443) |
| 90 C | OBD159_3481 | CTGTGATACTAACTGCTGGCGACTCA (SEQ ID NO: 4393) | OBD159_3483 | AGGAAGCCCAGATGCTGTGTGGTTTT (SEQ ID NO: 4444) |
| 91 C | OBD159_3465 | GAAGAAACTGAGGCTTGCCAAAGTCT (SEQ ID NO: 4394) | OBD159_3467 | GCAGAAGCATTCCAGGGTAGAAAACA (SEQ ID NO: 4445) |
| 92 C | OBD159_3385 | GGACTTCAAGGAGGTCTCTGGCTTCA (SEQ ID NO: 4395) | OBD159_3387 | GCCTGTTTCTACCAGTTTCAGTCTAT (SEQ ID NO: 4446) |
| 93 C | OBD159_3545 | GCCAAAGACTCCTCTGGGAATCCAAC (SEQ ID NO: 560) | OBD159_3547 | GAATCCTCCCTTTCCTTTCCTTGATG (SEQ ID NO: 4447) |
| 94 C | OBD159_3405 | GCTGAGGAGAGAAGAGCCAGGCAAAT (SEQ ID NO: 4397) | OBD159_3407 | CACTAAACCAGTTCAATCCTCGGCTT (SEQ ID NO: 4448) |
| 95 C | OBD159_3505 | GTGTTTACTTTGTTCCAGAGGTCACC (SEQ ID NO: 4398) | OBD159_3507 | GGAAAGAAAGCAGGATGGAGCAGAGC (SEQ ID NO: 4449) |
| 96 C | OBD159_3521 | CTTTCCAGAGAAGGTGTGTGCGTTTC (SEQ ID NO: 4399) | OBD159_3523 | GACGCTTTGCCTACTTACAGTTCACC (SEQ ID NO: 4450) |
| 97 C | OBD159_3489 | GGAAAAGGCTGACCTACCCAAACCAG (SEQ ID NO: 4400) | OBD159_3491 | GCAACACTGTCACAAAATGTCCCACT (SEQ ID NO: 4451) |
| 98 C | OBD159_3393 | GGATGGTTGGTTCTCACTTCAGATAA (SEQ ID NO: 4401) | OBD159_3395 | CCCAGCACAAGTCTACCACCTTATGC (SEQ ID NO: 4452) |
| 99 C | OBD159_3537 | GAAGCAGACTCCACAAACCCTTGGCT (SEQ ID NO: 4402) | OBD159_3539 | GCTGTGGACTGGGTAAATAAAGTGTG (SEQ ID NO: 1802) |
| 100 C | OBD159_3553 | GGACTGAGGTCTGTGTGGGAGGT (SEQ ID NO: 4403) | OBD159_3555 | CTCCAGCACAGCCTTGGGTTACA (SEQ ID NO: 4454) |
| 101 C | OBD159_3529 | CGTCAAGGGATGTCAGTGTTTACGCC (SEQ ID NO: 4404) | OBD159_3531 | GTCACTGGACTTTTGAATAGCAACAC (SEQ ID NO: 4455) |
| 102 C | OBD159_3425 | GCACAGGCAAACGCTCTAAGGGC (SEQ ID NO: 4405) | OBD159_3427 | GTGGGAGGACTGTTCATTGAGGC (SEQ ID NO: 4456) |

TABLE 9.3a

| No. | Group Probe | | GeneLocus | Probe_Count_Total |
|---|---|---|---|---|
| 103 | C | ORF19_7_107580951_107585747_107700145_107705340_RR | N/A | N/A |
| 104 | C | ORF1_10_25066818_25068552_25157986_25160553_FF | N/A | N/A |
| 105 | C | ORF179_16_73092061_73095486_73111263_73112287_FR | N/A | N/A |
| 106 | C | ORF1_X_143596265_143598228_143631538_143634098_RR | N/A | N/A |
| 107 | C | ORF16_19_51764536_51772179_51831790_51833005_FR | N/A | N/A |
| 108 | C | ORF109_8_103400307_103404391_103472915_103478806_RF | N/A | N/A |
| 109 | C | ORF14_20_46567001_46568090_46610481_46612493_FR | N/A | N/A |
| 110 | C | ORF19_8_103237571_103240055_103294738_103298438_FR | N/A | N/A |
| 111 | C | ORF15_21_17083642_17087491_17108209_17114129_FF | N/A | N/A |
| 112 | C | ORF13_1_65337853_65339914_65369795_65373287_RR | N/A | N/A |
| 113 | C | ORF143_6_46267215_46269920_46286216_46295988_RF | N/A | N/A |
| 114 | C | ORF166_2_38110623_38114294_38180978_38183484_FR | N/A | N/A |
| 115 | C | ORF18_1_13945271_13952984_13980703_13983186_FR | N/A | N/A |
| 116 | C | ORF13_14_99794535_99796770_99815362_99818414_RF | N/A | N/A |
| 117 | C | ORF112_X_147170464_147174350_147220072_147223222_RR | N/A | N/A |
| 118 | C | ORF11_10_3161199_3165742_3210550_3216745_RR | N/A | N/A |
| 119 | C | ORF14_11_86195747_86200973_86262730_86265020_RF | N/A | N/A |
| 120 | C | ORF11_12_83928300_83939202_83954032_83957600_FF | N/A | N/A |
| 121 | C | ORF19_5_6164451_6175882_6283431_6289065_FF | N/A | N/A |
| 122 | C | ORF142_4_20609595_20612048_20673951_20675409_FR | N/A | N/A |
| 123 | C | ORF15_2_78763526_78765449_78779355_78780963_FF | N/A | N/A |
| 124 | C | ORF111_20_19844341_19848170_19917735_19921318_FR | N/A | N/A |
| 125 | C | ORF168_7_138148315_138155407_138185877_138188419_RR | N/A | N/A |
| 126 | C | ORF162_16_89989921_89996258_90038173_90039606_FR | N/A | N/A |
| 127 | C | ORF166_2_195495210_195503375_195555062_195566669_RF | N/A | N/A |
| 128 | C | ORF163_20_57339344_57344067_57377470_57379133_FF | N/A | N/A |
| 129 | C | ORF1_7_41782337_41783687_41851521_41852628_RR | N/A | N/A |
| 130 | C | ORF179_11_34425831_34428416_34470619_34472082_RF | N/A | N/A |
| 131 | C | ORF11_16_75564971_75566881_75648010_75649086_RR | N/A | N/A |
| 132 | C | ORF11_13_99298431_99304510_99339091_99345466_FR | N/A | N/A |
| 133 | C | ORF1_16_51556847_51564565_51623942_51626175_RR | N/A | N/A |
| 134 | C | ORF101_20_19870175_19876327_19898126_19900554_FR | N/A | N/A |
| 135 | C | ORF111_2_200446136_200455550_200507238_200513664_FR | N/A | N/A |
| 136 | C | ORF13_10_25066818_25068552_25120749_25126820_FR | N/A | N/A |
| 137 | C | ORF109_9_28333777_28339631_28371887_28374860_FF | N/A | N/A |
| 138 | C | ORF122_8_31175232_31178937_31205589_31213041_FR | N/A | N/A |
| 139 | C | ORF15_9_96188932_96193703_96234157_96237688_FF | N/A | N/A |
| 140 | C | ORF197_10_106496977_106502145_106531472_106538179_RF | N/A | N/A |
| 141 | C | ORF105_14_52585153_52587568_52649397_52652795_RR | N/A | N/A |
| 142 | C | ORF177_6_157189218_157193153_157237058_157240060_RF | N/A | N/A |
| 143 | C | ORF15_2_39587442_39588976_39623225_39627003_RR | N/A | N/A |
| 144 | C | ORF13_16_14002832_14006140_14029360_14030604_RR | N/A | N/A |
| 145 | C | ORF11_2_39587442_39588976_39657947_39666343_RR | N/A | N/A |
| 146 | C | ORF1_10_96688596_96696898_96748228_96749907_FR | N/A | N/A |
| 147 | C | ORF124_11_104895593_104903291_104942780_104952074_RR | N/A | N/A |
| 148 | C | ORF197_10_93371665_93374909_93410956_93413925_RR | N/A | N/A |
| 149 | B | ORF16_16_13994577_13998645_14029360_14030604_RR | N/A | N/A |
| 150 | B | ORF15_2_19298458_19304309_19333103_19336336_RR | N/A | N/A |
| 151 | B | ORF10_8_104312502_104316292_104372432_104376137_FF | N/A | N/A |
| 152 | B | ORF1_10_25066818_25068552_25120749_25126820_FF | N/A | N/A |
| 153 | B | ORF128_2_177170392_177174097_177302614_177307613_FR | N/A | N/A |

TABLE 9.3b

| No. | Group | Probe_Count_Sig | HyperG_Stats | FDR_HyperG | Percent_Sig | logFC | AveExpr |
|---|---|---|---|---|---|---|---|
| 103 | C | N/A | N/A | N/A | N/A | −0.580384316 | −0.580384316 |
| 104 | C | N/A | N/A | N/A | N/A | −0.579795406 | −0.579795406 |
| 105 | C | N/A | N/A | N/A | N/A | −0.57645549 | −0.57645549 |
| 106 | C | N/A | N/A | N/A | N/A | −0.575761869 | −0.575761869 |
| 107 | C | N/A | N/A | N/A | N/A | −0.5704231 | −0.5704231 |
| 108 | C | N/A | N/A | N/A | N/A | −0.569099158 | −0.569099158 |
| 109 | C | N/A | N/A | N/A | N/A | −0.567902229 | −0.567902229 |
| 110 | C | N/A | N/A | N/A | N/A | −0.567643608 | −0.567643608 |
| 111 | C | N/A | N/A | N/A | N/A | −0.56761609 | −0.56761609 |
| 112 | C | N/A | N/A | N/A | N/A | −0.567337152 | −0.567337152 |
| 113 | C | N/A | N/A | N/A | N/A | −0.566513296 | −0.566513296 |
| 114 | C | N/A | N/A | N/A | N/A | −0.562334554 | −0.562334554 |
| 115 | C | N/A | N/A | N/A | N/A | −0.561180836 | −0.561180836 |
| 116 | C | N/A | N/A | N/A | N/A | −0.560245549 | −0.560245549 |
| 117 | C | N/A | N/A | N/A | N/A | −0.559624498 | −0.559624498 |
| 118 | C | V/A | N/A | N/A | N/A | −0.557407963 | −0.557407963 |
| 119 | C | N/A | N/A | N/A | N/A | −0.556319829 | −0.556319829 |
| 120 | C | N/A | N/A | N/A | N/A | −0.556012217 | −0.556012217 |
| 121 | C | N/A | N/A | N/A | N/A | −0.550953623 | −0.550953623 |

TABLE 9.3b-continued

| No. | Group | Probe_Count_Sig | HyperG_Stats | FDR_HyperG | Percent_Sig | logFC | AveExpr |
|-----|-------|-----------------|--------------|------------|-------------|-------|---------|
| 122 | C | N/A | N/A | N/A | N/A | -0.550934981 | -0.550934981 |
| 123 | C | N/A | N/A | N/A | N/A | -0.547738866 | -0.547738866 |
| 124 | C | N/A | N/A | N/A | N/A | -0.547460918 | -0.547460918 |
| 125 | C | N/A | N/A | N/A | N/A | -0.547355026 | -0.547355026 |
| 126 | C | N/A | N/A | N/A | N/A | -0.546619831 | -0.546619831 |
| 127 | C | N/A | N/A | N/A | N/A | -0.546571867 | -0.546571867 |
| 128 | C | N/A | N/A | N/A | N/A | -0.546225009 | -0.546225009 |
| 129 | C | N/A | N/A | N/A | N/A | -0.545327451 | -0.545327451 |
| 130 | C | N/A | N/A | N/A | N/A | -0.543525543 | -0.543525543 |
| 131 | C | N/A | N/A | N/A | N/A | -0.5428455 | -0.5428455 |
| 132 | C | N/A | N/A | N/A | N/A | -0.542118117 | -0.542118117 |
| 133 | C | N/A | N/A | N/A | N/A | -0.542064981 | -0.542064981 |
| 134 | C | N/A | N/A | N/A | N/A | -0.541750489 | -0.541750489 |
| 135 | C | N/A | N/A | N/A | N/A | -0.536534545 | -0.536534545 |
| 136 | C | N/A | N/A | N/A | N/A | -0.534704622 | -0.534704622 |
| 137 | C | N/A | N/A | N/A | N/A | -0.534170568 | -0.534170568 |
| 138 | C | N/A | N/A | N/A | N/A | -0.533764016 | -0.533764016 |
| 139 | C | N/A | N/A | N/A | N/A | -0.53216689 | -0.53216689 |
| 140 | C | N/A | N/A | N/A | N/A | -0.531944176 | -0.531944176 |
| 141 | C | N/A | N/A | N/A | N/A | -0.531556709 | -0.531556709 |
| 142 | C | N/A | N/A | N/A | N/A | -0.524769731 | -0.524769731 |
| 143 | C | N/A | N/A | N/A | N/A | -0.52447916 | -0.52447916 |
| 144 | C | N/A | N/A | N/A | N/A | -0.524161019 | -0.524161019 |
| 145 | C | N/A | N/A | N/A | N/A | -0.522994657 | -0.522994657 |
| 146 | C | N/A | N/A | N/A | N/A | -0.522456247 | -0.522456247 |
| 147 | C | N/A | N/A | N/A | N/A | -0.522415272 | -0.522415272 |
| 148 | C | N/A | N/A | N/A | N/A | -0.522311741 | -0.522311741 |
| 149 | B | N/A | N/A | N/A | N/A | -0.52076089 | -0.52076089 |
| 150 | B | N/A | N/A | N/A | N/A | -0.520350999 | -0.520350999 |
| 151 | B | N/A | N/A | N/A | N/A | -0.520217634 | -0.520217634 |
| 152 | B | N/A | N/A | N/A | N/A | -0.519498584 | -0.519498584 |
| 153 | B | N/A | N/A | N/A | N/A | -0.518845627 | -0.518845627 |

TABLE 9.3c

| No. | Group | t | P. Value | adj. P. Val | B | FC |
|-----|-------|---|----------|-------------|---|-----|
| 103 | C | -10.00265062 | 0.000000374 | 0.0000405 | 7.045948025 | 0.668785598 |
| 104 | C | -11.33939514 | 0.0000000954 | 0.0000179 | 8.404971577 | 0.669058652 |
| 105 | C | -8.286460787 | 0.00000271 | 0.000139101 | 5.04055063 | 0.670609353 |
| 106 | C | -6.252927722 | 0.0000434 | 0.000829019 | 2.201533666 | 0.670931847 |
| 107 | C | -5.792734053 | 0.0000875 | 0.001335671 | 1.479974689 | 0.673419265 |
| 108 | C | -6.040396591 | 0.0000598 | 0.001031804 | 1.872060278 | 0.674037537 |
| 109 | C | -8.299217518 | 0.00000267 | 0.000137526 | 5.056678015 | 0.674596983 |
| 110 | C | -7.531499725 | 0.00000716 | 0.000253765 | 4.050316707 | 0.674717924 |
| 111 | C | -3.833775368 | 0.002401501 | 0.013479024 | -1.906757953 | 0.674730794 |
| 112 | C | -5.920788535 | 0.0000718 | 0.001166281 | 1.683799077 | 0.674861262 |
| 113 | C | -3.723118962 | 0.002935801 | 0.015401869 | -2.109702831 | 0.675246754 |
| 114 | C | -9.974271127 | 0.000000385 | 0.0000414 | 7.015301538 | 0.67720543 |
| 115 | C | -5.013112028 | 0.00030752 | 0.003198461 | 0.189152517 | 0.677747205 |
| 116 | C | -4.940505936 | 0.000347203 | 0.003484861 | 0.064709444 | 0.678186726 |
| 117 | C | -4.593530372 | 0.00062628 | 0.00526829 | -0.539218116 | 0.678478734 |
| 118 | C | -6.214160763 | 0.0000460 | 0.000862205 | 2.141916694 | 0.67952194 |
| 119 | C | -5.930971965 | 0.0000707 | 0.001154102 | 1.699907371 | 0.680034654 |
| 120 | C | -6.525847027 | 0.0000290 | 0.000637435 | 2.615192535 | 0.680179666 |
| 121 | C | -5.680600812 | 0.000104299 | 0.001504687 | 1.299568985 | 0.682568801 |
| 122 | C | -6.017675982 | 0.0000619 | 0.00105584 | 1.836455913 | 0.68257762 |
| 123 | C | -7.594334912 | 0.00000658 | 0.000240229 | 4.135487936 | 0.684091464 |
| 124 | C | -5.090238268 | 0.000270538 | 0.002921847 | 0.320580403 | 0.684223273 |
| 125 | C | -12.15310973 | 0.0000000444 | 0.0000120 | 9.158075035 | 0.684273496 |
| 126 | C | -2.919821116 | 0.012907869 | 0.04460444 | -3.586971358 | 0.68462229 |
| 127 | C | -3.892386869 | 0.002160086 | 0.012450674 | -1.799543239 | 0.684645051 |
| 128 | C | -7.020143452 | 0.0000143 | 0.000399805 | 3.337793784 | 0.684809676 |
| 129 | C | -5.052407248 | 0.000288057 | 0.003052081 | 0.256212894 | 0.685235856 |
| 130 | C | -4.884054488 | 0.000381754 | 0.003716269 | -0.032519331 | 0.686092242 |
| 131 | C | 2.759734453 | 0.017361564 | 0.054595701 | -3.877268266 | 0.686415721 |
| 132 | C | -6.774152812 | 0.0000203 | 0.000504048 | 2.982425251 | 0.686761888 |
| 133 | C | -8.732503168 | 0.00000158 | 0.0000989 | 5.593040606 | 0.686787182 |
| 134 | C | -7.248122137 | 0.0000105 | 0.000325384 | 3.6597719 | 0.686936911 |
| 135 | C | -10.01824655 | 0.000000367 | 0.0000402 | 7.062756258 | 0.689424969 |
| 136 | C | -7.729829234 | 0.00000551 | 0.000216233 | 4.317411465 | 0.690299995 |
| 137 | C | -5.36337655 | 0.000173007 | 0.002142814 | 0.779549515 | 0.690555576 |
| 138 | C | -10.56605661 | 0.000000207 | 0.0000289 | 7.638430717 | 0.690750202 |
| 139 | C | -7.601300089 | 0.00000652 | 0.000238935 | 4.144897502 | 0.691515316 |
| 140 | C | -3.955401325 | 0.001928261 | 0.011499225 | -1.684522551 | 0.691622076 |

TABLE 9.3c-continued

| No. | Group | t | P. Value | adj. P. Val | B | FC |
|---|---|---|---|---|---|---|
| 141 | C | −8.15996529 | 0.00000318 | 0.000153403 | 4.879569025 | 0.691807851 |
| 142 | C | −6.889004942 | 0.0000172 | 0.000452456 | 3.149382339 | 0.695070041 |
| 143 | C | −6.412416451 | 0.0000342 | 0.000711704 | 2.444550132 | 0.695210049 |
| 144 | C | −4.429987328 | 0.000831579 | 0.006401704 | −0.828840478 | 0.695363372 |
| 145 | C | −4.461922671 | 0.000786579 | 0.006157605 | −0.772051332 | 0.695925773 |
| 146 | C | −7.396670725 | 0.00000857 | 0.000286972 | 3.865820271 | 0.69618554 |
| 147 | C | −7.159624596 | 0.0000118 | 0.000352082 | 3.535618488 | 0.696205313 |
| 148 | C | −7.046263262 | 0.0000138 | 0.000390254 | 3.375040231 | 0.696255276 |
| 149 | B | −4.940213927 | 0.000347373 | 0.00348576 | 0.064207565 | 0.69700413 |
| 150 | B | −6.676578229 | 0.0000233 | 0.0005504 | 2.839145562 | 0.697202188 |
| 151 | B | −8.649455976 | 0.00000174 | 0.000105182 | 5.491929731 | 0.697266641 |
| 152 | B | −6.284477315 | 0.0000414 | 0.000805255 | 2.249893478 | 0.69761425 |
| 153 | B | −5.014612232 | 0.000306752 | 0.003191623 | 0.191716487 | 0.697930059 |

TABLE 9.3d

| No. | Group | FC_1 | LS | Loop Detected |
|---|---|---|---|---|
| 103 | C | −1.495247511 | −1 | Mild Autism |
| 104 | C | −1.494637274 | −1 | Mild Autism |
| 105 | C | −1.491181111 | −1 | Mild Autism |
| 106 | C | −1.49046435 | −1 | Mild Autism |
| 107 | C | −1.484959002 | −1 | Mild Autism |
| 108 | C | −1.483596899 | −1 | Mild Autism |
| 109 | C | −1.482366547 | −1 | Mild Autism |
| 110 | C | −1.482100838 | −1 | Mild Autism |
| 111 | C | −1.482072568 | −1 | Mild Autism |
| 112 | C | −1.481786044 | −1 | Mild Autism |
| 113 | C | −1.480940107 | −1 | Mild Autism |
| 114 | C | −1.476656795 | −1 | Mild Autism |
| 115 | C | −1.47547639 | −1 | Mild Autism |
| 116 | C | −1.474520161 | −1 | Mild Autism |
| 117 | C | −1.473885547 | −1 | Mild Autism |
| 118 | C | −1.47162283 | −1 | Mild Autism |
| 119 | C | −1.470513296 | −1 | Mild Autism |
| 120 | C | −1.470199786 | −1 | Mild Autism |
| 121 | C | −1.465053778 | −1 | Mild Autism |
| 122 | C | −1.465034847 | −1 | Mild Autism |
| 123 | C | −1.461792834 | −1 | Mild Autism |
| 124 | C | −1.461511234 | −1 | Mild Autism |
| 125 | C | −1.461403965 | −1 | Mild Autism |
| 126 | C | −1.460659424 | −1 | Mild Autism |
| 127 | C | −1.460610865 | −1 | Mild Autism |
| 128 | C | −1.460259741 | −1 | Mild Autism |

TABLE 9.3d-continued

| No. | Group | FC_1 | LS | Loop Detected |
|---|---|---|---|---|
| 129 | C | −1.459351538 | −1 | Mild Autism |
| 130 | C | −1.457529964 | −1 | Mild Autism |
| 131 | C | −1.45684309 | −1 | Mild Autism |
| 132 | C | −1.456108759 | −1 | Mild Autism |
| 133 | C | −1.45605513 | −1 | Mild Autism |
| 134 | C | −1.455737761 | −1 | Mild Autism |
| 135 | C | −1.450484164 | −1 | Mild Autism |
| 136 | C | −1.448645527 | −1 | Mild Autism |
| 137 | C | −1.448109371 | −1 | Mild Autism |
| 138 | C | −1.44770135 | −1 | Mild Autism |
| 139 | C | −1.446099569 | −1 | Mild Autism |
| 140 | C | −1.445876346 | −1 | Mild Autism |
| 141 | C | −1.445488077 | −1 | Mild Autism |
| 142 | C | −1.43870393 | −1 | Mild Autism |
| 143 | C | −1.438414192 | −1 | Mild Autism |
| 144 | C | −1.438097029 | −1 | Mild Autism |
| 145 | C | −1.436934855 | −1 | Mild Autism |
| 146 | C | −1.436398694 | −1 | Mild Autism |
| 147 | C | −1.436357899 | −1 | Mild Autism |
| 148 | C | −1.436254826 | −1 | Mild Autism |
| 149 | B | −1.434711728 | −1 | Mild Autism |
| 150 | B | −1.434304163 | −1 | Mild Autism |
| 151 | B | −1.43417158 | −1 | Mild Autism |
| 152 | B | −1.433456956 | −1 | Mild Autism |
| 153 | B | −1.432808327 | −1 | Mild Autism |

TABLE 9.3e

| No. | Group | Probe sequence 60 mer | Probe Location Chr |
|---|---|---|---|
| 103 | C | CGTTAGGTGAGTTTATTTTCAAAGACTTTCGATGGTTTTAAAAAATGTATCAAGTCCACA (SEQ ID NO: 4457) | 7 |
| 104 | C | TGATTTACTTTAAAATACTTTCGTGCAATCGATGTCCTAGTTTTTGTACTAGGTGGTGGA (SEQ ID NO: 4458) | 10 |
| 105 | C | AATGTATTGCTGCTGAAACATTAACCTTTCGATTCTGCTTTTGTTTTTGTTTTTTCCCTT (SEQ ID NO: 4459) | 16 |
| 106 | C | ATATAGTACAAACATATATTAATGGTAATCGAGTTTGTACCACAAAGCCATTTTGATTAG (SEQ ID NO: 4460) | X |
| 107 | C | CACCACCAATAAACATTTCTAGACTTGCTCGATTATGTTAGTAATTACACTAGTAATATC (SEQ ID NO: 4461) | 19 |
| 108 | C | ATGCTATGTCTCTTTTATTTTTAACTTCTCGAATATGAGCCATGTTTCTATGCAGAATTC (SEQ ID NO: 4462) | 8 |
| 109 | C | GCTTACTCAGAACTTAAAAATTTCATAATCGAACCTCCTTCTGGCCAAAGAGACTTTTCA (SEQ ID NO: 4463) | 20 |
| 110 | C | TTCTAAAACAGTTTTTTATTTGAGATCTTCGATTTTAACTTGGAGAAACTTTGCTCTGCT (SEQ ID NO: 4464) | 8 |

TABLE 9.3e-continued

| No. | Group | Probe sequence 60 mer | Probe Location Chr |
|---|---|---|---|
| 111 | C | CAGCAAGCAATAATGTACATAATATAACTCGACTTTCTTAAAAGGCGTGTATATTCAAAA (SEQ ID NO: 4465) | 21 |
| 112 | C | GTAAGAATACTGATGTCCCTCTATATACTCGATTCACTTTTATGCTTAGAAGCCACATTG (SEQ ID NO: 4466) | 1 |
| 113 | C | TTTTTTTTTTTTTTAACAGCAATGTTCATCGAAAGGAATAATGTTGTTCTTTTTAGAAAA (SEQ ID NO: 4467) | 6 |
| 114 | C | TATAAATACCAGAGAAGAAGCCATATTTTCGAAGGGCATGAACATTTTTATGACTCTTGG (SEQ ID NO: 4468) | 2 |
| 115 | C | TACATTTTTAGCTCATCATAAAAGATATTCGATACACCAAGCAGACAAAATTCTGGCTTG (SEQ ID NO: 4469) | 1 |
| 116 | C | ATATTTAATGTCCTATATCTGCAGATATTCGACACCTGTTTGTCACTGTAGCAGTAAAGA (SEQ ID NO: 4470) | 14 |
| 117 | C | AACTTTAAAATTTAATTACTGTTACTATTCGATAAATATGATACTCCTCTCCACTTACTT (SEQ ID NO: 4471) | X |
| 118 | C | ACATCTAGATGAAGTTTAAAATGTAAGATCGACAGACCTTGCACATTTGTATGCGAAGTC (SEQ ID NO: 4472) | 10 |
| 119 | C | GATTCCTTTGTGAGAATCATACCTTCCTTCGACAATGGGTTATTCAGGAATTTAAACTTT (SEQ ID NO: 4473) | 11 |
| 120 | C | AAGAAAATTTTTTCTCTAAGCACTCTGATCGATGAATCAACATTTTCCAAAATAATACAT (SEQ ID NO: 4474) | 12 |
| 121 | C | CTCTGCTTCCCTTTATTTACATCATTAGTCGATATAACTGGATGAATATCTACTGTTTTT (SEQ ID NO: 4475) | 5 |
| 122 | C | TTCATTAGAATCCACTTCATTAAATCTTTCGAAGATGGGATACTATTGACAAGGGGTCAC (SEQ ID NO: 4476) | 4 |
| 123 | C | CTATATTGTAGCTCTATTTTCTCTAAATTCGAACACTCTTGTCTTGCCCTCATTTGAGCC (SEQ ID NO: 4477) | 2 |
| 124 | C | GTTAAGTGGTGTACTTTTTGAAAATCCATCGATATATACTGTACATCTCAAGAAATATGT (SEQ ID NO: 4478) | 20 |
| 125 | C | TAAGCCAGTTTAATTGAATAACGAATCCTCGACATATCTCTTTCAGGGACATTCAAATCA (SEQ ID NO: 4479) | 7 |
| 126 | C | ACATTCAGCTATAAAAAGGAATAAAGTATCGAGAGCTCACCTCTGAAAGCACATGAGGGA (SEQ ID NO: 4480) | 16 |
| 127 | C | CTAGTTTCCCTAGAGCTTACTGATAATCTCGAAGAGGAAAATTTTTCAGACATTAATTTG (SEQ ID NO: 4481) | 2 |
| 128 | C | TGATAATATTATTTATTTGAAAAGTTTCTCGATACTAGAATTTTACACTCAGCAAGTCAG (SEQ ID NO: 4482) | 20 |
| 129 | C | TTCAATTTTGGTCAATTTATTTCAACCATCGAAACTTTCCAAATTCATTTGTTTAAATCT (SEQ ID NO: 4483) | 7 |
| 130 | C | TAAGAACAGAGATGGTATTTTCTTTCTTTCGATTGAGTAGTTTCACTGAGGGGGTACAAA (SEQ ID NO: 4484) | 11 |
| 131 | C | CATCATTTCCTACACTGGAAATTCCTGATCGACGCTCATCCTGCACGGCGGCGGCACCGT (SEQ ID NO: 4485) | 16 |
| 132 | C | ATTTCTTGTATCTCTAGGTGATGTATGATCGACCTTTTCCTTGAGTTCTAGAATTACATA (SEQ ID NO: 4486) | 13 |
| 133 | C | TCTCTCTGATGCATCTGCTTTGGATAGGTCGAGCTGTTTTTTTCTGAAGGCAATTTATTG (SEQ ID NO: 4487) | 16 |
| 134 | C | ATCTTCAGGTCGTATAAATCTTTTGCCTTCGAACAGAAATTCCTTTTCATATTTTCAAAA (SEQ ID NO: 4488) | 20 |
| 135 | C | TGCACTCAGAAAGTGATCAGCTCACATTTCGAGATATGCTAAGAAGTTGGAAAATGTTGG (SEQ ID NO: 4489) | 2 |
| 136 | C | TGATTTACTTTAAAATACTTTCGTGCAATCGAGTAACATGCTTCTTGATATCAACAGTCT (SEQ ID NO: 4490) | 10 |

TABLE 9.3e-continued

| No. | Group | Probe sequence 60 mer | Probe Location Chr |
|---|---|---|---|
| 137 | C | GCCCACTAAATAGTAATATTAGGATCTATCGAGGTGGGTCAATTTGTCAAATTAAAAGAA (SEQ ID NO: 4491) | 9 |
| 138 | C | TTACTACAATTACTATATTCTATTAATATCGAGGGAAACCTACTCTCTCTTCAAGGCCAA (SEQ ID NO: 4492) | 8 |
| 139 | C | TTGCAGACTAGAATTCATCCAAAACTTTTCGAGTTTGCCAGGATTTAGAAAGATCATTGT (SEQ ID NO: 4493) | 9 |
| 140 | C | TCATTTTACCGAGTGTAAATTGTTGTTTTCGACTCCATTTCGCTTCTAACCTCTGAGCTG (SEQ ID NO: 4494) | 10 |
| 141 | C | ATATAGTATGGATTCTGATATTTTGATATCGATGTTTACCAGAAACTGCTTTTTAAAAAA (SEQ ID NO: 4495) | 14 |
| 142 | C | GTCCTAATATTTTATACATAAACCAGTTTCGAGTTGATGCACAAAAATTTTCATCCCATT (SEQ ID NO: 4496) | 6 |
| 143 | C | ACTATTTTTAAGTGCACAGTTTAACAATTCGATTCAGCTGGGGAAAAATGAAAATAACAA (SEQ ID NO: 4497) | 2 |
| 144 | C | TCTTAATTTGATTTTCTCTGGCTCAGAATCGAGATATTACACTCCAGCCTGGGTGACGGA (SEQ ID NO: 4316) | 16 |
| 145 | C | ACTATTTTTAAGTGCACAGTTTAACAATTCGAGAATTGAAGACAAAATCAGAGTGGTCCA (SEQ ID NO: 4499) | 2 |
| 146 | C | CCTTGATAGGATTTGGAAAAATATTAGATCGAAAACAGAAAGCAGATAAGGATTCCCATC (SEQ ID NO: 4500) | 10 |
| 147 | C | TCTTTTTTAGACAACTGTTTATTAGCAGTCGAAAATCCAGTTAGCTTCCTCCACTTCATT (SEQ ID NO: 4501) | 11 |
| 148 | C | TACCTATGAATATTTACTATAATAGAGATCGAGCTATGTGAGTCTGAGTAAGTTTCTTAA (SEQ ID NO: 4502) | 10 |
| 149 | B | GCAGGTGAGTCAGACTTTGGGATTCAGTTCGAGATATTACACTCCAGCCTGGGTGACGGA (SEQ ID NO: 4503) | 16 |
| 150 | B | CTTTCCCTGATTAATTACTTTCTAGTAATCGATGAATGAATGAATGAAGCCAAGGAAAAT (SEQ ID NO: 4504) | 2 |
| 151 | B | ACCTGATGCTATCTTTAAGTGGCAGACATCGACTGTTCTTCTCTTTCTATGGGGAAGTTC (SEQ ID NO: 4505) | 8 |
| 152 | B | TGATTTACTTTAAAATACTTTCGTGCAATCGATAATAATAATAACCATTAATTGGGCAGG (SEQ ID NO: 4506) | 10 |
| 153 | B | ATCTCTAAAATTGATAAATTGCTGCTTATCGAGTTTGGTTCAGCAGAGCTTTCTGTAAAG (SEQ ID NO: 4507) | 2 |

TABLE 9.3f

| | | Probe Location | | | | 4 kb Sequence Location | |
|---|---|---|---|---|---|---|---|
| No. | Group | Start1 | End1 | Start2 | End2 | Chr | Start1 |
| 103 | C | 107580953 | 107580982 | 107700147 | 107700176 | 7 | 107580953 |
| 104 | C | 25068521 | 25068550 | 25160522 | 25160551 | 10 | 25064551 |
| 105 | C | 73095455 | 73095484 | 73111265 | 73111294 | 16 | 73091485 |
| 106 | C | 143596267 | 143596296 | 143631540 | 143631569 | X | 143596267 |
| 107 | C | 51772148 | 51772177 | 51831792 | 51831821 | 19 | 51768178 |
| 108 | C | 103400309 | 103400338 | 103478775 | 103478804 | 8 | 103400309 |
| 109 | C | 46568059 | 46568088 | 46610483 | 46610512 | 20 | 46564089 |
| 110 | C | 103240024 | 103240053 | 103294740 | 103294769 | 8 | 103236054 |
| 111 | C | 17087460 | 17087489 | 17114098 | 17114127 | 21 | 17083490 |
| 112 | C | 65337855 | 65337884 | 65369797 | 65369826 | 1 | 65337855 |
| 113 | C | 46267217 | 46267246 | 46295957 | 46295986 | 6 | 46267217 |
| 114 | C | 38114263 | 38114292 | 38180980 | 38181009 | 2 | 38110293 |
| 115 | C | 13952953 | 13952982 | 13980705 | 13980734 | 1 | 13948983 |
| 116 | C | 99794537 | 99794566 | 99818383 | 99818412 | 14 | 99794537 |
| 117 | C | 147170466 | 147170495 | 147220074 | 147220103 | X | 147170466 |
| 118 | C | 3161201 | 3161230 | 3210552 | 3210581 | 10 | 3161201 |

TABLE 9.3f-continued

| No. | Group | Probe Location | | | | 4 kb Sequence Location | |
|---|---|---|---|---|---|---|---|
| | | Start1 | End1 | Start2 | End2 | Chr | Start1 |
| 119 | C | 86195749 | 86195778 | 86264989 | 86265018 | 11 | 86195749 |
| 120 | C | 83939171 | 83939200 | 83957569 | 83957598 | 12 | 83935201 |
| 121 | C | 6175851 | 6175880 | 6289034 | 6289063 | 5 | 6171881 |
| 122 | C | 20612017 | 20612046 | 20673953 | 20673982 | 4 | 20608047 |
| 123 | C | 78765418 | 78765447 | 78780932 | 78780961 | 2 | 78761448 |
| 124 | C | 19848139 | 19848168 | 19917737 | 19917766 | 20 | 19844169 |
| 125 | C | 138148317 | 138148346 | 138185879 | 138185908 | 7 | 138148317 |
| 126 | C | 89996227 | 89996256 | 90038175 | 90038204 | 16 | 89992257 |
| 127 | C | 195495212 | 195495241 | 195566638 | 195566667 | 2 | 195495212 |
| 128 | C | 57344036 | 57344065 | 57379102 | 57379131 | 20 | 57340066 |
| 129 | C | 41782339 | 41782368 | 41851523 | 41851552 | 7 | 41782339 |
| 130 | C | 34425833 | 34425862 | 34472051 | 34472080 | 11 | 34425833 |
| 131 | C | 75564973 | 75565002 | 75648012 | 75648041 | 16 | 75564973 |
| 132 | C | 99304479 | 99304508 | 99339093 | 99339122 | 13 | 99300509 |
| 133 | C | 51556849 | 51556878 | 51623944 | 51623973 | 16 | 51556849 |
| 134 | C | 19876296 | 19876325 | 19898128 | 19898157 | 20 | 19872326 |
| 135 | C | 200455519 | 200455548 | 200507240 | 200507269 | 2 | 200451549 |
| 136 | C | 25068521 | 25068550 | 25120751 | 25120780 | 10 | 25064551 |
| 137 | C | 28339600 | 28339629 | 28374829 | 28374858 | 9 | 28335630 |
| 138 | C | 31178906 | 31178935 | 31205591 | 31205620 | 8 | 31174936 |
| 139 | C | 96193672 | 96193701 | 96237657 | 96237686 | 9 | 96189702 |
| 140 | C | 106496979 | 106497008 | 106538148 | 106538177 | 10 | 106496979 |
| 141 | C | 52585155 | 52585184 | 52649399 | 52649428 | 14 | 52585155 |
| 142 | C | 157189220 | 157189249 | 157240029 | 157240058 | 6 | 157189220 |
| 143 | C | 39587444 | 39587473 | 39623227 | 39623256 | 2 | 39587444 |
| 144 | C | 14002834 | 14002863 | 14029362 | 14029391 | 16 | 14002834 |
| 145 | C | 39587444 | 39587473 | 39657949 | 39657978 | 2 | 39587444 |
| 146 | C | 96696867 | 96696896 | 96748230 | 96748259 | 10 | 96692897 |
| 147 | C | 104895595 | 104895624 | 104942782 | 104942811 | 11 | 104895595 |
| 148 | C | 93371667 | 93371696 | 93410958 | 93410987 | 10 | 93371667 |
| 149 | B | 13994579 | 13994608 | 14029362 | 14029391 | 16 | 13994579 |
| 150 | B | 19298460 | 19298489 | 19333105 | 19333134 | 2 | 19298460 |
| 151 | B | 104316261 | 104316290 | 104376106 | 104376135 | 8 | 104312291 |
| 152 | B | 25068521 | 25068550 | 25126789 | 25126818 | 10 | 25064551 |
| 153 | B | 177174066 | 177174095 | 177302616 | 177302645 | 2 | 177170096 |

TABLE 9.3g

| No. | Group | 4 kb Sequence Location | | | Probe |
|---|---|---|---|---|---|
| | | End1 | Start2 | End2 | |
| 103 | C | 107584952 | 107700147 | 107704146 | ORF19_7_107580951_107585747_107700145_107705340_RR |
| 104 | C | 25068550 | 25156552 | 25160551 | ORF1_10_25066818_25068552_25157986_25160553_FF |
| 105 | C | 73095484 | 73111265 | 73115264 | ORF179_16_73092061_73095486_73111263_73112287_FR |
| 106 | C | 143600266 | 143631540 | 143635539 | ORF1_X_143596265_143598228_143631538_143634098_RR |
| 107 | C | 51772177 | 51831792 | 51835791 | ORF16_19_51764536_51772179_51831790_51833005_FR |
| 108 | C | 103404308 | 103474805 | 103478804 | ORF109_8_103400307_103404391_103472915_103478806_RF |
| 109 | C | 46568088 | 46610483 | 46614482 | ORF14_20_46567001_46568090_46610481_46612493_FR |
| 110 | C | 103240053 | 103294740 | 103298739 | ORF19_8_103237571_103240055_103294738_103298438_FR |
| 111 | C | 17087489 | 17110128 | 17114127 | ORF15_21_17083642_17087491_17108209_17114129_FF |
| 112 | C | 65341854 | 65369797 | 65373796 | ORF13_1_65337853_65339914_65369795_65373287_RR |
| 113 | C | 46271216 | 46291987 | 46295986 | ORF143_6_46267215_46269920_46286216_46295988_RF |
| 114 | C | 38114292 | 38180980 | 38184979 | ORF166_2_38110623_38114294_38180978_38183484_FR |
| 115 | C | 13952982 | 13980705 | 13984704 | ORF18_1_13945271_13952984_13980703_13983186_FR |
| 116 | C | 99798536 | 99814413 | 99818412 | ORF13_14_99794535_99796770_99815362_99818414_RF |
| 117 | C | 147174465 | 147220074 | 147224073 | ORF112_X_147170464_147174350_147220072_147223222_RR |
| 118 | C | 3165200 | 3210552 | 3214551 | ORF11_10_3161199_3165742_3210550_3216745_RR |
| 119 | C | 86199748 | 86261019 | 86265018 | ORF14_11_86195747_86200973_86262730_86265020_RF |
| 120 | C | 83939200 | 83953599 | 83957598 | ORF11_12_83928300_83939202_83954032_83957287_RR |
| 121 | C | 6175880 | 6285064 | 6289063 | ORF19_5_6164451_6175882_6283431_6289065_FF |
| 122 | C | 20612046 | 20673953 | 20677952 | ORF142_4_20609595_20612048_20673951_20675409_FR |
| 123 | C | 78765447 | 78776962 | 78780961 | ORF15_2_78763526_78765449_78779355_78780963_FF |
| 124 | C | 19848168 | 19917737 | 19921736 | ORF111_20_19844341_19848170_19917763_19921318_FR |
| 125 | C | 138152316 | 138185879 | 138189878 | ORF168_7_138148315_138155407_138185877_138188419_RR |
| 126 | C | 89996256 | 90038175 | 90042174 | ORF162_16_89989921_89996258_90038173_90039606_FR |
| 127 | C | 195499211 | 195562668 | 195566667 | ORF166_2_195495210_195503375_195555062_195566669_RF |
| 128 | C | 57344065 | 57375132 | 57379131 | ORF163_20_57339344_57344760_57377470_57379133_FF |
| 129 | C | 41786338 | 41851523 | 41855522 | ORF1_7_41782337_41783687_41851521_41852628_FR |
| 130 | C | 34429832 | 34468081 | 34472080 | ORF179_11_34425831_34428416_34470619_34472082_RF |
| 131 | C | 75568972 | 75648012 | 75652011 | ORF11_16_75564971_75566881_75648010_75649086_RR |
| 132 | C | 99304508 | 99339093 | 99343092 | ORF11_13_99298431_99304510_99339091_99345466_FR |
| 133 | C | 51560848 | 51623944 | 51627943 | ORF1_16_51556847_51564565_51623942_51626175_RR |

TABLE 9.3g-continued

|  |  | 4 kb Sequence Location |  |  |
| No. | Group | End1 | Start2 | End2 | Probe |
| --- | --- | --- | --- | --- | --- |
| 134 | C | 19876325 | 19898128 | 19902127 | ORF101_20_19870175_19876327_19898126_19900554_FR |
| 135 | C | 200455548 | 200507240 | 200511239 | ORF111_2_200446136_200455550_200507238_200513664_FR |
| 136 | C | 25068550 | 25120751 | 25124750 | ORF13_10_25066818_25068552_25120749_25126820_FR |
| 137 | C | 28339629 | 28370859 | 28374858 | ORF109_9_28333777_28339631_28371887_28374860_FF |
| 138 | C | 31178935 | 31205591 | 31209590 | ORF122_8_31175232_31178937_31205589_31213041_FR |
| 139 | C | 96193701 | 96233687 | 96237686 | ORF15_9_96188932_96193703_96234157_96237688_FF |
| 140 | C | 106500978 | 106534178 | 106538177 | ORF197_10_106496977_106502145_106531472_106538179_RF |
| 141 | C | 52589154 | 52649399 | 52653398 | ORF105_14_52585153_52587568_52649397_52652795_RR |
| 142 | C | 157193219 | 157236059 | 157240058 | ORF177_6_157189218_157193153_157237058_157240060_RF |
| 143 | C | 39591443 | 39623227 | 39627226 | ORF15_2_39587442_39588976_39623225_39627003_RR |
| 144 | C | 14006833 | 14029362 | 14033361 | ORF13_16_14002832_14006140_14029360_14030604_RR |
| 145 | C | 39591443 | 39657949 | 39661948 | ORF11_2_39587442_39588976_39657947_39666343_RR |
| 146 | C | 96696896 | 96748230 | 96752229 | ORF1_10_96688596_96696898_96748228_96749907_FR |
| 147 | C | 104899594 | 104942782 | 104946781 | ORF124_11_104895593_104903291_104942780_104952074_RR |
| 148 | C | 93375666 | 93410958 | 93414957 | ORF197_10_93371665_93374909_93410956_93413925_RR |
| 149 | B | 13998578 | 14029362 | 14033361 | ORF16_16_13994577_13998645_14029360_14030604_RR |
| 150 | B | 19302459 | 19333105 | 19337104 | ORF15_2_19298458_19304309_19333103_19336336_RR |
| 151 | B | 104316290 | 104372136 | 104376135 | ORF10_8_104312502_104316292_104372432_104376137_FF |
| 152 | B | 25068550 | 25122819 | 25126818 | ORF1_10_25066818_25068552_25120749_25126820_FF |
| 153 | B | 177174095 | 177302616 | 177306615 | ORF128_2_177170392_177174097_177302614_177307613_FR |

TABLE 9.3h

| No. | Group | PCR-Primer1_ID | PCR_Primer1 | PCR-Primer2_ID | PCR_Primer2 |
| --- | --- | --- | --- | --- | --- |
| 103 | C | OBD159_3421 | CTGAGACAAGGCAGGGCAGGTGT (SEQ ID NO: 4508) | OBD159_3423 | GCCTATTCCTGATTGGACCCCAG (SEQ ID NO: 4559) |
| 104 | C | OBD159_3557 | GTATCTCACGCACACAAAGGGACACT (SEQ ID NO: 4509) | OBD159_3559 | CCTTCCTTTCCCTTCCCTTTCTGTTC (SEQ ID NO: 4560) |
| 105 | C | OBD159_3565 | AGACATCCCACACCCATCTTGCCTCT (SEQ ID NO: 4510) | OBD159_3567 | GATTGTTAGACCTCCCATTAGTGTGT (SEQ ID NO: 4561) |
| 106 | C | OBD159_3469 | GCAGTAACAGACCCAAGGGCATAATA (SEQ ID NO: 4511) | OBD159_3471 | CCTCCCATTTCCATCCTCCAGTGAAC (SEQ ID NO: 4562) |
| 107 | C | OBD159_3589 | CTGAGGATTCTTGGTGTTTATGGGAC (SEQ ID NO: 4512) | OBD159_3591 | CGTCAAAGGCTCTCAGACCAGCAAAG (SEQ ID NO: 4563) |
| 108 | C | OBD159_3381 | TTTCTCTACCCTTTATCTACCTCCTA (SEQ ID NO: 4513) | OBD159_3383 | AGCCTGCTGTATTACCTTTGTGGT (SEQ ID NO: 4564) |
| 109 | C | OBD159_3497 | ATGCTCAATGCTGTCCCCTGGTG (SEQ ID NO: 4514) | OBD159_3499 | AGCAACACCGCCTCCACTGCCAT (SEQ ID NO: 4565) |
| 110 | C | OBD159_3517 | CATACCCAGCAGTGTGACAAGGC (SEQ ID NO: 4515) | OBD159_3519 | GGCAGTGGCTTGCTCTGTGTCCT (SEQ ID NO: 4566) |
| 111 | C | OBD159_3457 | CTCTGCCCAGGAGCACAGTAATGAAG (SEQ ID NO: 4516) | OBD159_3459 | TACCCTATTGCTGGAGGAGATGAAAA (SEQ ID NO: 4567) |
| 112 | C | OBD159_3581 | ATGAGCCTGGAACATCTGGTGATACC (SEQ ID NO: 1324) | OBD159_3583 | CGCTTTTGAATGCTGGGCTATGTGCT (SEQ ID NO: 4568) |
| 113 | C | OBD159_3641 | GGAAGCAAGGAAGTAGGCTATGGAAC (SEQ ID NO: 4518) | OBD159_3643 | GTGAACCACCATACCGACCCTCTTTA (SEQ ID NO: 4569) |
| 114 | C | OBD159_3413 | TGTGAAGGGCAGTGAATAAAGGATTA (SEQ ID NO: 2096) | OBD159_3415 | GGCGTCAGTGTAAACAAATCAAGTCA (SEQ ID NO: 4570) |
| 115 | C | OBD159_3409 | TGCTGTGTGACCTTGGGATGTCC (SEQ ID NO: 244) | OBD159_3411 | CAGAAAGATGCCAGTGAGCCCAGC (SEQ ID NO: 4571) |
| 116 | C | OBD159_3621 | CCAAACCAAGGAGGTGACAATGGAGG (SEQ ID NO: 3689) | OBD159_3623 | CCACTACAGAGGATGAATCAACACAC (SEQ ID NO: 4572) |
| 117 | C | OBD159_3525 | AGGCAGGCAGTCCAGAGATGTGC (SEQ ID NO: 4522) | OBD159_3527 | GGAACAAAGCCCTGCCAATGCCT (SEQ ID NO: 4573) |
| 118 | C | OBD159_3445 | CTGGATTCTCTCAACCCCGAGTGTGT (SEQ ID NO: 4523) | OBD159_3447 | AACAGCAGAAGTCCAGTAGAAGTTGG (SEQ ID NO: 4574) |

TABLE 9.3h-continued

| No. | Group | PCR-Primer1_ID | PCR_Primer1 | PCR-Primer2_ID | PCR_Primer2 |
|-----|-------|----------------|-------------|----------------|-------------|
| 119 | C | OBD159_3417 | CCATTCTCTTTGGGTGGCGTGGTAT (SEQ ID NO: 4524) | OBD159_3419 | CTTTGAGAAGTTGGTCCACATACTGC (SEQ ID NO: 4575) |
| 120 | C | OBD159_3501 | GAAGGATTTGAGTTCAGAGGAATGGA (SEQ ID NO: 4525) | OBD159_3503 | GGAAACTGAAACCGTAACAAGGAACA (SEQ ID NO: 3561) |
| 121 | C | OBD159_3441 | CCTCTGGTATCTTTGGTCACTGTGGA (SEQ ID NO: 4526) | OBD159_3443 | GCTCAATAAAGCAAAAGACAGCAGAA (SEQ ID NO: 4577) |
| 122 | C | OBD159_3613 | AAGGGAACAAATCTAAGTGCTGTGGC (SEQ ID NO: 4527) | OBD159_3615 | GCCGCATAGAGAAATGAGTGGAGGGT (SEQ ID NO: 4578) |
| 123 | C | OBD159_3493 | GAACTACTCTTTGTGTTATCTTGGTC (SEQ ID NO: 4528) | OBD159_3495 | ATTGCTTGGGATGTTTTGAGGCTC (SEQ ID NO: 4579) |
| 124 | C | OBD159_3617 | GGGACATTGAGGTGTTGGTGGCATTC (SEQ ID NO: 4529) | OBD159_3619 | GCTGTGGACTGGGTAAATAAAGTGTG (SEQ ID NO: 1802) |
| 125 | C | OBD159_3633 | ACTGGTAAAATCTGAGAAAAGACAGC (SEQ ID NO: 4530) | OBD159_3635 | CAAGGTGAAGTCTGGAGGGAAAGAGA (SEQ ID NO: 4581) |
| 126 | C | OBD159_3645 | GTCCTTCAGCAGGGATGAGTCTG (SEQ ID NO: 4531) | OBD159_3647 | TGTGAGGACCAGCACTGAGCAGC (SEQ ID NO: 4582) |
| 127 | C | OBD159_3549 | AATACTGGCAAGAACCCATCTACTGC (SEQ ID NO: 1522) | OBD159_3551 | GAAGAGTTGGGAACATTATCCTAAGG (SEQ ID NO: 4583) |
| 128 | C | OBD159_3433 | GATTGATGTAGTCTTCAGTGTTTTGC (SEQ ID NO: 4533) | OBD159_3435 | GGGTCTGTCACTGTATTTCTCACCTG (SEQ ID NO: 4584) |
| 129 | C | OBD159_3573 | CCTGAGTGGCAAGTTGTTGGAGACAT (SEQ ID NO: 4534) | OBD159_3575 | GGAGGCAGAGTGAATAAAGGGTTGGT (SEQ ID NO: 4585) |
| 130 | C | OBD159_3437 | CATCAGAAGATAACTTGAGCACCGTC (SEQ ID NO: 4535) | OBD159_3439 | GCCTGTGGACTCTTTCCTCTCTATCC (SEQ ID NO: 4586) |
| 131 | C | OBD159_3585 | AAGGCAGTCTGGTCTGGGTCACC (SEQ ID NO: 4536) | OBD159_3587 | GTGGAGATGAAATCACCCGAGGC (SEQ ID NO: 4587) |
| 132 | C | OBD159_3605 | CCTCTGAAAGGCAGTGTGGGTGT (SEQ ID NO: 4537) | OBD159_3607 | GCTACTGAGTGGGCAGGTGGCTA (SEQ ID NO: 4588) |
| 133 | C | OBD159_3429 | CAGGGTTGCCTTGGGTTAGGGTT (SEQ ID NO: 4538) | OBD159_3431 | AGTGAGGAAAGCCCTGGACTCCC (SEQ ID NO: 4589) |
| 134 | C | OBD159_3541 | GCAGACTCCACAAACCCTTGGCT (SEQ ID NO: 4539) | OBD159_3543 | GAAGTCCCCTGGCGAAGATGAGC (SEQ ID NO: 2458) |
| 135 | C | OBD159_3477 | AAGGCACTGGCACTCTACCTAATGTG (SEQ ID NO: 4540) | OBD159_3479 | GCCTCTCCTTTGTTTGCTGTGTGACA (SEQ ID NO: 4591) |
| 136 | C | OBD159_3473 | TATCTCACGCACACAAAGGGACACTT (SEQ ID NO: 4541) | OBD159_3475 | CAGAGCCATTCAAGGAGCCAAAAGGC (SEQ ID NO: 4592) |
| 137 | C | OBD159_3513 | GTCCAGTAGTATGGTGGCTGTGAATA (SEQ ID NO: 4542) | OBD159_3515 | CCAGAGCCCCAAATAAGGATGGAAGC (SEQ ID NO: 4593) |
| 138 | C | OBD159_3461 | CCCTGCCATTTGAAAGGTATTTGCCT (SEQ ID NO: 4543) | OBD159_3463 | CTACAACCAAGATGCTAAGACAGTTT (SEQ ID NO: 4594) |
| 139 | C | OBD159_3629 | GACCACAGGTATGCTGGGAATCC (SEQ ID NO: 4544) | OBD159_3631 | AGGGCGTGCTATCTTTGCCTGGC (SEQ ID NO: 4595) |
| 140 | C | OBD159_3561 | CCACACACACAGAAAACTCAAGGCTG (SEQ ID NO: 4545) | OBD159_3563 | GCTTGTTCTACACCCAGGAATGACCA (SEQ ID NO: 4596) |
| 141 | C | OBD159_3601 | GAGAGCGAGAGCAAGAGAGAGTTAGT (SEQ ID NO: 4546) | OBD159_3603 | GGTAGAGAGTCTTGATGTAACAGAAT (SEQ ID NO: 4597) |
| 142 | C | OBD159_3569 | AATCAATCTCCTCTGGTCGCTCCCAC (SEQ ID NO: 4547) | OBD159_3571 | GGCTTTAGGCAGAAGAGTGTTCATTC (SEQ ID NO: 4598) |
| 143 | C | OBD159_3609 | GCTATTCAGTTCCTACATCTTATTCC (SEQ ID NO: 4548) | OBD159_3611 | CTGGCTACTCTTGAAACACCCACTTG (SEQ ID NO: 4599) |
| 144 | C | OBD159_3597 | CCATTCCTTCCTCCCCACCGAGA (SEQ | OBD159_3599 | TGCCATTAGTGAGCACCTCTGGG (SEQ |

TABLE 9.3h-continued

| No. | Group | PCR-Primer1_ID | PCR_Primer1 | PCR-Primer2_ID | PCR_Primer2 |
|---|---|---|---|---|---|
| | | | ID NO: 4367) | | ID NO: 4418) |
| 145 | C | OBD159_3577 | GCTATTCAGTTCCTACATCTTATTCC (SEQ ID NO: 4548) | OBD159_3579 | GATTCCCATTGTCAAGACCAGGAGAC (SEQ ID NO: 4601) |
| 146 | C | OBD159_3593 | CCCCATTATCTTTCTATGAACCCACA (SEQ ID NO: 4551) | OBD159_3595 | CGTGTGTGAATGACTCTTTGTGCTTG (SEQ ID NO: 4602) |
| 147 | C | OBD159_3625 | CAAGAGCAAGGACCCTGAGACAG (SEQ ID NO: 4552) | OBD159_3627 | CACAAGCAGCCCAGCCCTCCTTA (SEQ ID NO: 4603) |
| 148 | C | OBD159_3533 | TGGGAGAGGAGACAAAGGCACCT (SEQ ID NO: 4553) | OBD159_3535 | CCAGATACTGTGCTAAAGGCTTCGCC (SEQ ID NO: 4604) |
| 149 | B | OBD159_4317 | CGTGCTAAACGGATGTTCTCGGG (SEQ ID NO: 4554) | OBD159_4319 | CTGCCATTAGTGAGCACCTCTGGG (SEQ ID NO: 4605) |
| 150 | B | OBD159_4321 | GATAGATGGTCTCTGCCCCAGCA (SEQ ID NO: 4555) | OBD159_4323 | CACCGTGCTGCCAAGTTGACTCC (SEQ ID NO: 4606) |
| 151 | B | OBD159_4325 | CCAGACAGAGGGTGTAACCAGGC (SEQ ID NO: 4556) | OBD159_4327 | CCTCCTTCCCATTCTTGGCTTCC (SEQ ID NO: 4607) |
| 152 | B | OBD159_4329 | CGAGTATCTCACGCACACAAAGGGAC (SEQ ID NO: 4557) | OBD159_4331 | CCAGTCTCAGTGGAGGATTTTGAAGA (SEQ ID NO: 4608) |
| 153 | B | OBD159_4333 | AGCACCCTCAGAACTCTTTCCCC (SEQ ID NO: 4558) | OBD159_4335 | CACCTCCCCTGTCACCTGATGTC (SEQ ID NO: 4609) |

TABLE 9.4a

| No. | Group | Probe | GeneLocus | Probe_Count_Total |
|---|---|---|---|---|
| 154 | B | ORF164_4_175570706_175582842_175638077_175645518_RR | N/A | N/A |
| 155 | B | ORF183_6_47042220_47043847_47060758_47069708_FF | N/A | N/A |
| 156 | B | ORF134_22_22364163_22372094_22390196_22400635_FF | N/A | N/A |
| 157 | B | ORF18_X_130732955_130739067_130792590_130793708_FF | N/A | N/A |
| 158 | B | ORF192_5_31151647_31161110_31225743_31233894_FF | N/A | N/A |
| 159 | B | ORF171_2_209621630_209626755_209684451_209692640_FR | N/A | N/A |
| 160 | B | ORF1_21_17365003_17366218_17434190_17435748_RR | N/A | N/A |
| 161 | B | ORF17_2_209476172_209481006_209522065_209524486_RF | N/A | N/A |
| 162 | B | ORF12_22_16921135_16923046_16991720_16993357_FR | N/A | N/A |
| 163 | B | ORF15_2_66446190_66449017_66492459_66494190_FR | N/A | N/A |
| 164 | B | ORF122_9_114576757_114578280_114619457_114622460_FR | N/A | N/A |
| 165 | B | ORF153_15_99350884_99352277_99419798_99424615_FF | N/A | N/A |
| 166 | B | ORF103_16_86444065_86445243_86506730_86509704_FF | N/A | N/A |
| 167 | B | ORF13_20_19800689_19803183_19923213_19926075_FF | N/A | N/A |
| 168 | B | ORF159_16_56062438_56065089_56102507_56114718_RF | N/A | N/A |
| 169 | B | ORF161_5_93562856_93565579_93582366_93583770_RR | N/A | N/A |
| 170 | B | ORF183_5_65124085_65127368_65185445_65188078_FR | N/A | N/A |
| 171 | B | ORF186_4_175618295_175622237_175682057_175691642_FR | N/A | N/A |
| 172 | D | ORF149_6_149229853_149231712_149287970_149291658_FR | N/A | N/A |
| 173 | D | ORF192_10_12596194_12598368_12616738_12619998_RF | N/A | N/A |
| 174 | D | ORF10_1_177039010_177043486_177103748_177111201_RF | N/A | N/A |
| 175 | D | ORF168_12_30144610_30146709_30181629_30184999_RR | N/A | N/A |
| 176 | D | ORF111_13_34426191_34433129_34463898_34472100_FR | N/A | N/A |
| 177 | D | ORF12_3_46807202_46811416_46833087_46839270_RF | N/A | N/A |
| 178 | D | ORF175_3_69167897_69172562_69218117_69221087_FR | N/A | N/A |
| 179 | D | ORF19_20_46511970_46518882_46567001_46568090_RF | N/A | N/A |
| 180 | D | ORF171_18_11015786_11021011_11118494_11119843_RR | N/A | N/A |
| 181 | D | ORF10_6_154294994_154298490_154323035_154324807_FR | N/A | N/A |
| 182 | D | ORF16_6_13526281_13531876_13559103_13561354_RR | N/A | N/A |

TABLE 9.4b

| No. | Group | Probe_Count_Sig | HyperG_Stats | FDR_HyperG | Percent_Sig | logFC | AveExpr |
|-----|-------|-----------------|--------------|------------|-------------|-------|---------|
| 154 | B | N/A | N/A | N/A | N/A | −0.518230715 | −0.518230715 |
| 155 | B | N/A | N/A | N/A | N/A | −0.514627947 | −0.514627947 |
| 156 | B | N/A | N/A | N/A | N/A | −0.513201545 | −0.513201545 |
| 157 | B | N/A | N/A | N/A | N/A | −0.512145378 | −0.512145378 |
| 158 | B | N/A | N/A | N/A | N/A | −0.511060289 | −0.511060289 |
| 159 | B | N/A | N/A | N/A | N/A | −0.508206748 | −0.508206748 |
| 160 | B | N/A | N/A | N/A | N/A | −0.507746284 | −0.507746284 |
| 161 | B | N/A | N/A | N/A | N/A | −0.507097731 | −0.507097731 |
| 162 | B | N/A | N/A | N/A | N/A | −0.506726527 | −0.506726527 |
| 163 | B | N/A | N/A | N/A | N/A | −0.506585597 | −0.506585597 |
| 164 | B | N/A | N/A | N/A | N/A | −0.50422625 | −0.50422625 |
| 165 | B | N/A | N/A | N/A | N/A | −0.504110943 | −0.504110943 |
| 166 | B | N/A | N/A | N/A | N/A | −0.503540575 | −0.503540575 |
| 167 | B | N/A | N/A | N/A | N/A | −0.503236536 | −0.503236536 |
| 168 | B | N/A | N/A | N/A | N/A | −0.502476785 | −0.502476785 |
| 169 | B | N/A | N/A | N/A | N/A | −0.502379183 | −0.502379183 |
| 170 | B | N/A | N/A | N/A | N/A | −0.502230544 | −0.502230544 |
| 171 | B | N/A | N/A | N/A | N/A | −0.502183005 | −0.502183005 |
| 172 | D | N/A | N/A | N/A | N/A | −0.966851209 | −0.966851209 |
| 173 | D | N/A | N/A | N/A | N/A | −0.847700439 | −0.847700439 |
| 174 | D | N/A | N/A | N/A | N/A | −0.762732385 | −0.762732385 |
| 175 | D | N/A | N/A | N/A | N/A | −0.741191529 | −0.741191529 |
| 176 | D | N/A | N/A | N/A | N/A | −0.700803469 | −0.700803469 |
| 177 | D | N/A | N/A | N/A | N/A | −0.683750198 | −0.683750198 |
| 178 | D | N/A | N/A | N/A | N/A | −0.658137917 | −0.658137917 |
| 179 | D | N/A | N/A | N/A | N/A | −0.631933144 | −0.631933144 |
| 180 | D | N/A | N/A | N/A | N/A | −0.629601593 | −0.629601593 |
| 181 | D | N/A | N/A | N/A | N/A | −0.627203595 | −0.627203595 |
| 182 | D | N/A | N/A | N/A | N/A | −0.624247879 | −0.624247879 |

TABLE 9.4c

| No. | Group | t | P. Value | adj. P. Val | B | FC |
|-----|-------|---|----------|-------------|---|-----|
| 154 | B | −5.362195428 | 0.000173338 | 0.002145992 | 0.77758692 | 0.698227597 |
| 155 | B | −8.49945946 | 0.00000209 | 0.00011818 | 5.307288691 | 0.699973424 |
| 156 | B | −9.314864265 | 0.000000799 | 0.0000646 | 6.280404769 | 0.700665835 |
| 157 | B | −5.055587241 | 0.000286539 | 0.003042515 | 0.261630837 | 0.701178965 |
| 158 | B | −5.496900549 | 0.000139574 | 0.001839195 | 1.000161135 | 0.701706539 |
| 159 | B | −9.322309266 | 0.000000792 | 0.0000641 | 6.28895319 | 0.703095834 |
| 160 | B | −6.545895416 | 0.0000282 | 0.000624419 | 2.645164027 | 0.703320277 |
| 161 | B | −4.126423931 | 0.001419892 | 0.009176186 | −1.373842162 | 0.70363652 |
| 162 | B | −4.624780959 | 0.000593485 | 0.005070443 | −0.484223374 | 0.703817589 |
| 163 | B | −11.97780294 | 0.0000000521 | 0.0000130 | 9.000200149 | 0.703886345 |
| 164 | B | −5.745709994 | 0.0000942 | 0.001400448 | 1.404538274 | 0.705038404 |
| 165 | B | −9.017723551 | 0.00000113 | 0.0000797 | 5.934356857 | 0.705094756 |
| 166 | B | −2.412457641 | 0.032864394 | 0.086824691 | −4.493238931 | 0.70537357 |
| 167 | B | −6.832978663 | 0.0000187 | 0.000475944 | 3.068166532 | 0.705522239 |
| 168 | B | −11.14627179 | 0.000000115 | 0.0000202 | 8.218374966 | 0.705893878 |
| 169 | B | −8.732794743 | 0.00000158 | 0.0000989 | 5.593394212 | 0.705941636 |
| 170 | B | −11.52540775 | 0.0000000798 | 0.0000163 | 8.581775324 | 0.706014371 |
| 171 | B | −7.81270396 | 0.00000495 | 0.000202535 | 4.427527157 | 0.706037636 |
| 172 | D | −13.63931618 | 0.0000000122 | 0.00000609 | 10.40829899 | 0.511621498 |
| 173 | D | −8.230893339 | 0.00000291 | 0.000144892 | 4.970072391 | 0.555669732 |
| 174 | D | −3.262995276 | 0.00683472 | 0.02833772 | −2.957420767 | 0.589379022 |
| 175 | D | −5.848734747 | 0.0000802 | 0.001260075 | 1.569399495 | 0.598245055 |
| 176 | D | −7.105211691 | 0.0000127 | 0.000368733 | 3.458758895 | 0.615229476 |
| 177 | D | −7.565911003 | 0.00000684 | 0.00024651 | 4.097023669 | 0.622544902 |
| 178 | D | −5.942956947 | 0.0000694 | 0.001140129 | 1.718846375 | 0.633695679 |
| 179 | D | −6.513707717 | 0.0000295 | 0.000644318 | 2.597017253 | 0.645311149 |
| 180 | D | −4.978576007 | 0.000325767 | 0.003332827 | 0.13004571 | 0.646354884 |
| 181 | D | −6.084970954 | 0.0000558 | 0.000984165 | 1.941696022 | 0.647430127 |
| 182 | D | −4.384389265 | 0.000900527 | 0.00678304 | −0.910115349 | 0.648757907 |

TABLE 9.4d

| No. | Group | FC_1 | LS | Loop Detected |
|-----|-------|------|-----|---------------|
| 154 | B | −1.432197759 | −1 | Mild Autism |
| 155 | B | −1.428625667 | −1 | Mild Autism |
| 156 | B | −1.427213874 | −1 | Mild Autism |

60

65

TABLE 9.4d-continued

| No. | Group | FC_1 | LS | Loop Detected |
|-----|-------|------|-----|---------------|
| 157 | B | −1.426169422 | −1 | Mild Autism |
| 158 | B | −1.425097167 | −1 | Mild Autism |
| 159 | B | −1.422281219 | −1 | Mild Autism |

TABLE 9.4d-continued

| No. | Group | FC_1 | LS | Loop Detected |
|-----|-------|------|-----|---------------|
| 160 | B | −1.421827342 | −1 | Mild Autism |
| 161 | B | −1.421188314 | −1 | Mild Autism |
| 162 | B | −1.42082269 | −1 | Mild Autism |
| 163 | B | −1.420683904 | −1 | Mild Autism |
| 164 | B | −1.418362452 | −1 | Mild Autism |
| 165 | B | −1.418249095 | −1 | Mild Autism |
| 166 | B | −1.417688502 | −1 | Mild Autism |
| 167 | B | −1.417389765 | −1 | Mild Autism |
| 168 | B | −1.416643537 | −1 | Mild Autism |
| 169 | B | −1.4165477 | −1 | Mild Autism |
| 170 | B | −1.416401763 | −1 | Mild Autism |
| 171 | B | −1.416355091 | −1 | Mild Autism |

TABLE 9.4d-continued

| No. | Group | FC_1 | LS | Loop Detected |
|-----|-------|------|-----|---------------|
| 172 | D | −1.95456994 | −1 | Mild Autism |
| 173 | D | −1.799630146 | −1 | Mild Autism |
| 174 | D | −1.696701042 | −1 | Mild Autism |
| 175 | D | −1.671555815 | −1 | Mild Autism |
| 176 | D | −1.625409768 | −1 | Mild Autism |
| 177 | D | −1.606309838 | −1 | Mild Autism |
| 178 | D | −1.578044531 | −1 | Mild Autism |
| 179 | D | −1.549640049 | −1 | Mild Autism |
| 180 | D | −1.547137685 | −1 | Mild Autism |
| 181 | D | −1.544568222 | −1 | Mild Autism |
| 182 | D | −1.541407033 | −1 | Mild Autism |

TABLE 9.4e

| No. | Group | Probe sequence 60 mer | Probe Location Chr |
|-----|-------|------------------------|--------------------|
| 154 | B | TTTTGCAAGTTGTTACTAGTACTGAATTTCGATTTACTTTGTCAGCATGTAGGACTTCCT (SEQ ID NO: 4610) | 4 |
| 155 | B | GTGGAAAAAAGCTAATCTCATAATCTAGTCGATTTACAAAACACAATTTACCTTTTCCAA (SEQ ID NO: 4611) | 6 |
| 156 | B | CCTTCCCTCGTATTCAGTGAGATTCATTTCGAAGCTCTGGAATGAATTTTCTTGGATCCT (SEQ ID NO: 4612) | 22 |
| 157 | B | CCTTCTACAGGGAAGTGATGGAATTACTTCGAATAATTCACCCTTTACCAGGCCTGGGAG (SEQ ID NO: 4613) | X |
| 158 | B | AAAGAAAAGTCTGGATGACAATCTTTATTCGAAGCAAGTGAATGATAGTCAGGTAATATA (SEQ ID NO: 4614) | 5 |
| 159 | B | CAATATTATATGTAGAGATTCTTTCATATCGACCATATGCTGTGATGCCACAACAAGCAA (SEQ ID NO: 4615) | 2 |
| 160 | B | AACTGGTAATAAGTTATGCCTATGAATGTCGAATTCATGTTTTTTCTCTTGGAATTTTCT (SEQ ID NO: 4616) | 21 |
| 161 | B | CTTTATGATAATTGCTATGTTAGTAGCCTCGAGACCATGATTGTGGATCCTAGTTTTGGA (SEQ ID NO: 4617) | 2 |
| 162 | B | TACCTTTATTTTTGAAGCATATCTTCACTCGAGGTGTCTGAAGAAACACCAAAAATGCCT (SEQ ID NO: 4618) | 22 |
| 163 | B | CAAAGTACTACTTTAATTTATGACATAATCGATAACTCTTTCACTTGGCTGCCCTCTCTA (SEQ ID NO: 4619) | 2 |
| 164 | B | TATGCATATATGTATATATATGTAGCTATCGAAAGGCAAACAAAGACATCCTGAAGGATC (SEQ ID NO: 4620) | 9 |
| 165 | B | TTATGGTTTTCTTCCAGAGTAGAAATCTTCGATTATTCTTTTCTTCCCTGCCACCTTGGG (SEQ ID NO: 4621) | 15 |
| 166 | B | TATATACATATACATATGTATGTATATGTCGACTCCGGTCCTCGCGGCCGGCCGGCTAAG (SEQ ID NO: 4622) | 16 |
| 167 | B | TTCATTCTCTTTTACCTGTCTATTTTCCTCGACAAATTGTAATGAGGTTTATCCACACTG (SEQ ID NO: 4623) | 20 |
| 168 | B | GAGCCTTTACATATATTAGCTCATTTACTCGATGAAAGCATCCCATTGTCTTTTCCATAC (SEQ ID NO: 4624) | 16 |
| 169 | B | AATTATGTGACCATTGTGCTTATTGTTCTCGAATTTGTGGCAATAGCTGCAAATTCCAGG (SEQ ID NO: 4625) | 5 |
| 170 | B | ACTCCAAAATGGTCTCATTCTTACTGAATCGACCTGTGCTTATCCCAGAATTGTTTCCTG (SEQ ID NO: 4626) | 5 |
| 171 | B | CTAAGCAGAGACTAAGAATATCTTAAAGTCGACAGTGAAGTCAAGGCTGACAAGGTCTCA (SEQ ID NO: 4627) | 4 |
| 172 | D | AAAACACCTAAAATTAAGCAAAGTATTTTCGATCATAAAATTATGTTAAGCAAAGAATTA (SEQ ID NO: 1159) | 6 |
| 173 | D | TTTTCACTCAACTTTCACTGGAGATTTATCGACAAAATAAATGTAGTAGAATTTCTTTGA | 10 |

TABLE 9.4e-continued

| No. | Group | Probe sequence 60 mer | Probe Location Chr |
|-----|-------|----------------------|----------------------|
| | | (SEQ ID NO: 1400) | |
| 174 | D | ACTGAATTCTCACAACCATCCTGGTGTTTCGAATAAAAGAATCTGGATCTATTAAATGTC (SEQ ID NO: 1085) | 1 |
| 175 | D | CTTCCAGTATTAAGGATATAGCTGAGAATCGAAGTCTCAGCTGAGGGATTACTTCTTCAG (SEQ ID NO: 1359) | 12 |
| 176 | D | TACGTTAATTAAATAAATTTGTGCTCACTCGAAACAGGTTGGTTTTACACAAAGAGGTGT (SEQ ID NO: 1105) | 13 |
| 177 | D | CTACAGTATATCATCTAAGATGTCTTCTTCGACTAACGTTTACTTGGCACTTGATGTTTT (SEQ ID NO: 1114) | 3 |
| 178 | D | ATTGTGACAATCACATTTTAAGTACTCTTCGAAAGAGAATGATCTGAACATTTTAGGATG (SEQ ID NO: 1376) | 3 |
| 179 | D | GCTTACTCAGAACTTAAAAATTTCATAATCGAATACTCTTCTCTGATGCTGAATTTTATA (SEQ ID NO: 1393) | 20 |
| 180 | D | TTCGTGTTTATTGTTTTCCATAAGAAATTCGATTGCATCTAACCTTTGGATCTCATTCAA (SEQ ID NO: 1370) | 18 |
| 181 | D | TTCATGAGTCATAGTCAATTATATAATCTCGATGTGACAAGTGCTTTTAAACAAGAGATT (SEQ ID NO: 1089) | 6 |
| 182 | D | GGAACTATTACTTAAACTCTTAAACTCTTCGACATGATTAAGGTATTTCCCTTTTTCTCT (SEQ ID NO: 1350) | 6 |

TABLE 9.4f

| No. | Group | Probe Location | | | | 4 kb Sequence Location | |
|-----|-------|--------|------|--------|------|-----|--------|
| | | Start1 | End1 | Start2 | End2 | Chr | Start1 |
| 154 | B | 175570708 | 175570737 | 175638079 | 175638108 | 4 | 175570708 |
| 155 | B | 47043816 | 47043845 | 47069677 | 47069706 | 6 | 47039846 |
| 156 | B | 22372063 | 22372092 | 22400604 | 22400633 | 22 | 22368093 |
| 157 | B | 130739036 | 130739065 | 130793677 | 130793706 | X | 130735066 |
| 158 | B | 31161079 | 31161108 | 31233863 | 31233892 | 5 | 31157109 |
| 159 | B | 209626724 | 209626753 | 209684453 | 209684482 | 2 | 209622754 |
| 160 | B | 17365005 | 17365034 | 17434192 | 17434221 | 21 | 17365005 |
| 161 | B | 209476174 | 209476203 | 209524455 | 209524484 | 2 | 209476174 |
| 162 | B | 16923015 | 16923044 | 16991722 | 16991751 | 22 | 16919045 |
| 163 | B | 66448986 | 66449015 | 66492461 | 66492490 | 2 | 66445016 |
| 164 | B | 114578249 | 114578278 | 114619459 | 114619488 | 9 | 114574279 |
| 165 | B | 99352246 | 99352275 | 99424584 | 99424613 | 15 | 99348276 |
| 166 | B | 86445212 | 86445241 | 86509673 | 86509702 | 16 | 86441242 |
| 167 | B | 19803152 | 19803181 | 19926044 | 19926073 | 20 | 19799182 |
| 168 | B | 56062440 | 56062469 | 56114687 | 56114716 | 16 | 56062440 |
| 169 | B | 93562858 | 93562887 | 93582368 | 93582397 | 5 | 93562858 |
| 170 | B | 65127337 | 65127366 | 65185447 | 65185476 | 5 | 65123367 |
| 171 | B | 175622206 | 175622235 | 175682059 | 175682088 | 4 | 175618236 |
| 172 | D | 149231681 | 149231710 | 149287972 | 149288001 | 6 | 149227711 |
| 173 | D | 12596196 | 12596225 | 12619967 | 12619996 | 10 | 12596196 |
| 174 | D | 177039012 | 177039041 | 177111170 | 177111199 | 1 | 177039012 |
| 175 | D | 30144612 | 30144641 | 30181631 | 30181660 | 12 | 30144612 |
| 176 | D | 34433098 | 34433127 | 34463900 | 34463929 | 13 | 34429128 |
| 177 | D | 46807204 | 46807233 | 46839239 | 46839268 | 3 | 46807204 |
| 178 | D | 69172531 | 69172560 | 69218119 | 69218148 | 3 | 69168561 |
| 179 | D | 46511972 | 46512001 | 46568059 | 46568088 | 20 | 46511972 |
| 180 | D | 11015788 | 11015817 | 11118496 | 11118525 | 18 | 11015788 |
| 181 | D | 154298459 | 154298488 | 154323037 | 154323066 | 6 | 154294489 |
| 182 | D | 13526283 | 13526312 | 13559105 | 13559134 | 6 | 13526283 |

TABLE 9.4g

| | | 4 kb Sequence Location | | |
| No. | Group | End1 | Start2 | End2 | Probe |
|---|---|---|---|---|---|
| 154 | B | 175574707 | 175638079 | 175642078 | ORF164_4_175570706_175582842_175638077_175645518_RR |
| 155 | B | 47043845 | 47065707 | 47069706 | ORF183_6_47042220_47043847_47060758_47069708_FF |
| 156 | B | 22372092 | 22396634 | 22400633 | ORF134_22_22364163_22372094_22390196_22400635_FF |
| 157 | B | 130739065 | 130789707 | 130793706 | ORF18_X_130732955_130739067_130792590_130793708_FF |
| 158 | B | 31161108 | 31229893 | 31233892 | ORF192_5_31151647_31161110_31225743_31233894_FF |
| 159 | B | 209626753 | 209684453 | 209688452 | ORF171_2_209621630_209626755_209684451_209692640_FR |
| 160 | B | 17369004 | 17434192 | 17438191 | ORF1_21_17365003_17366218_17434190_17435748_RR |
| 161 | B | 209480173 | 209520485 | 209524484 | ORF17_2_209476172_209481006_209522065_209524486_RF |
| 162 | B | 16923044 | 16991722 | 16995721 | ORF12_22_16921135_16923046_16991720_16993357_FR |
| 163 | B | 66449015 | 66492461 | 66496460 | ORF15_2_66446190_66449017_66492459_66494190_FR |
| 164 | B | 114578278 | 114619459 | 114623458 | ORF122_9_114576757_114578280_114619457_114622460_FR |
| 165 | B | 99352275 | 99420614 | 99424613 | ORF153_15_99350884_99352277_99419798_99424615_FF |
| 166 | B | 86445241 | 86505703 | 86509702 | ORF103_16_86444065_86445243_86506730_86509704_FF |
| 167 | B | 19803181 | 19922074 | 19926073 | ORF13_20_19800689_19803183_19923213_19926075_FF |
| 168 | B | 56066439 | 56110717 | 56114716 | ORF159_16_56062438_56065089_56102507_56114718_RF |
| 169 | B | 93566857 | 93582368 | 93586367 | ORF161_5_93562856_93565579_93582366_93583770_RR |
| 170 | B | 65127366 | 65185447 | 65189446 | ORF183_5_65124085_65127368_65185445_65188078_FR |
| 171 | B | 175622235 | 175682059 | 175686058 | ORF186_4_175618295_175622237_175682057_175691642_FR |
| 172 | D | 149231710 | 149287972 | 149291971 | ORF149_6_149229853_149231712_149287970_149291658_FR |
| 173 | D | 12600195 | 12615997 | 12619996 | ORF192_10_12596194_12598368_12616738_12619998_RF |
| 174 | D | 177043011 | 177107200 | 177111199 | ORF10_1_177039010_177043486_177103748_177111201_RF |
| 175 | D | 30148611 | 30181631 | 30185630 | ORF168_12_30144610_30146709_30181629_30184999_RR |
| 176 | D | 34433127 | 34463900 | 34467899 | ORF111_13_34426191_34433129_34463898_34472100_FR |
| 177 | D | 46811203 | 46835269 | 46839268 | ORF12_3_46807202_46811416_46833087_46839270_RF |
| 178 | D | 69172560 | 69218119 | 69222118 | ORF175_3_69167897_69172562_69218117_69221087_FR |
| 179 | D | 46515971 | 46564089 | 46568088 | ORF19_20_46511970_46518882_46567001_46568090_RF |
| 180 | D | 11019787 | 11118496 | 11122495 | ORF171_18_11015786_11021011_11118494_11119843_RR |
| 181 | D | 154298488 | 154323037 | 154327036 | ORF10_6_154294994_154298490_154323035_154324807_FR |
| 182 | D | 13530282 | 13559105 | 13563104 | ORF16_6_13526281_13531876_13559103_13561354_RR |

35

40

45

50

55

60

65

TABLE 9.4h

| No. | Group | PCR-Primer1_ID | PCR_Primer1 | PCR-Primer2_ID | PCR_Primer2 |
|---|---|---|---|---|---|
| 154 | B | OBD159_4337 | GCCTAAAACTTCAGCCTAAAGGATGA (SEQ ID NO: 4639) | OBD159_4339 | TACCAGGAATAATAAAGCAGGGACTT (SEQ ID NO: 4648) |
| 155 | B | OBD159_4341 | ACCCACTTGTCTTCCACACCAGC (SEQ ID NO: 4640) | OBD159_4343 | GGGTTGCTGGCTGGAGTCTTCTG (SEQ ID NO: 4649) |
| 156 | B | OBD159_4345 | TGGGACTCAGGACTCATTGCTGCC (SEQ ID NO: 4641) | OBD159_4347 | CTGTCTCTACCCAATAATGTCAGGTC (SEQ ID NO: 4650) |
| 157 | B | OBD159_4349 | GCCAAGTCTAACACCTGCTTTGAAGA (SEQ ID NO: 4642) | OBD159_4351 | GAATGCTCTGTTCCATCTGGGTGCTG (SEQ ID NO: 4651) |
| 158 | B | OBD159_4353 | CACCTTCAGGCTGGCATCTCCCT (SEQ ID NO: 4643) | OBD159_4355 | CGCCTCACTCTCTACTACTCAGC (SEQ ID NO: 4652) |
| 159 | B | OBD159_4357 | CCATTCTTCCAGAGATGTCAAAACCC (SEQ ID NO: 238) | OBD159_4359 | CACTGGGCTAATGTAAGGTTTGCCAT (SEQ ID NO: 4653) |
| 160 | B | OBD159_4361 | CTAATACAGTCTTCTACCCAAAATGG (SEQ ID NO: 4645) | OBD159_4363 | GGCAGAGAAAGTTTTGTCCTCAGTTC (SEQ ID NO: 4654) |
| 161 | B | OBD159_4365 | CACACATAATCCAGAGTCAGGGAGAG (SEQ ID NO: 2392) | OBD159_4367 | GACTGCTATCACTTTGAGATGGACAG (SEQ ID NO: 4655) |
| 162 | B | OBD159_4369 | CCATCTGCTGTCATTTCCTGTGATTC (SEQ ID NO: 4647) | OBD159_4371 | AAGCACAGGTATGGGAGCACACACAG (SEQ ID NO: 4656) |
| 163 | B | OBD159_4373 | CCACTGTCAGGGAAATAGTTGAAGGA (SEQ ID NO: 728) | OBD159_4375 | GAAACCAGCCAGATGAGAGCAACAGC (SEQ ID NO: 4677) |
| 164 | B | OBD159_4377 | AACCCCTGATTCCTTTCTTCCCTACT (SEQ ID NO: 4658) | OBD159_4379 | TGGAGACTCAGAACCATTCCCAGGTC (SEQ ID NO: 4678) |
| 165 | B | OBD159_4381 | GCCAGGGTGATTAGACCAAGGAG (SEQ ID NO: 4659) | OBD159_4383 | TGGCATAGCCGACCTGTGCTTGC (SEQ ID NO: 4679) |
| 166 | B | OBD159_4385 | AAGAGAGACGCCCAGAAGCCAGAAA (SEQ ID NO: 4660) | OBD159_4387 | AGAGTGGGTAGGCGGTCCCTCGC (SEQ ID NO: 4680) |
| 167 | B | OBD159_4389 | GCACTGCCATCTGTGGGCTGAGA (SEQ ID NO: 4661) | OBD159_4391 | GGGAACACACACACAGGTGACCA (SEQ ID NO: 4681) |
| 168 | B | OBD159_4393 | GATAGGGTTTTGCCACCTTGGATAAG (SEQ ID NO: 4662) | OBD159_4395 | GCCAATACCATTTCCTTGACCAGGGC (SEQ ID NO: 4682) |
| 169 | B | OBD159_4397 | GTCCTGTTTTGAATGCCCAGTTCTTT (SEQ ID NO: 4663) | OBD159_4399 | GAGCGTGAAGAGAGTGTCATTGAAAA (SEQ ID NO: 4683) |
| 170 | B | OBD159_4401 | CTATCGGCGGGCTTTAGCAGTGC (SEQ ID NO: 4664) | OBD159_4403 | GGGACCACTGCCTCAGATAAAGC (SEQ ID NO: 4684) |
| 171 | B | OBD159_4405 | CCTGGATGGAAACAGACACAACACAA (SEQ ID NO: 4665) | OBD159_4407 | GTGTGACCTTTGCTCCAGTGCCCTAT (SEQ ID NO: 4685) |
| 172 | D | OBD159_1013 | ATTGACTGTCTTGGGAAAAGCACTTA (SEQ ID NO: 1241) | OBD159_1015 | GGGACTGAGTGACACAAGGACCATTT (SEQ ID NO: 1323) |
| 173 | D | OBD159_1321 | GTAGCAAACCCACTTCCCTCCTGC (SEQ ID NO: 1482) | OBD159_1323 | CTCTTCTGTTTGTGAGGGCTGCC (SEQ ID NO: 1564) |
| 174 | D | OBD159_717 | GCCCCTCTTCTTTGCCAAGCACT (SEQ ID NO: 1167) | OBD159_719 | GCCAAGGGTTCAGAAAGCCCAGG (SEQ ID NO: 1249) |
| 175 | D | OBD159_1157 | CATTCTTCCCTCAGCCATCCATTTGG (SEQ ID NO: 1441) | OBD159_1159 | GCCTTTTATTCTGTGTGTGGCTAAGC (SEQ ID NO: 1523) |
| 176 | D | OBD159_797 | CACAGTGGGCTCAGTGTCAACAAACC (SEQ ID NO: 1187) | OBD159_799 | CTCTCTTGGTGTTTGGAAATCTGTGC (SEQ ID NO: 1269) |
| 177 | D | OBD159_833 | CCAGCAAAAGGCAGGAATCAGTGC (SEQ ID NO: 1196) | OBD159_835 | GGAAAGTCCCAGGCTCCAGGAAG (SEQ ID NO: 1278) |
| 178 | D | OBD159_1225 | GTGTCTCGGAGTCTCTTTGAACCAGC (SEQ ID NO: 1458) | OBD159_1227 | CCGACTTACGGTGTCCATTATTATGC (SEQ ID NO: 1540) |
| 179 | D | OBD159_1293 | CTACCATAGCCCTTTTATCAATCCAG (SEQ ID NO: 1475) | OBD159_1295 | CCATTCGCCATTCTTCCTTACCCAGC (SEQ ID NO: 1557) |

TABLE 9.4h-continued

| No. | GroupPCR-Primer1_ID | PCR_Primer1 | PCR-Primer2_ID | PCR_Primer2 |
|---|---|---|---|---|
| 180 | D | OBD159_1201 | GAGAATGTCACCAGGATTGCCCAAGC (SEQ ID NO: 1452) | OBD159_1203 | CATTCCAGCATTGGTTGGCATTTGAA (SEQ ID NO: 1534) |
| 181 | D | OBD159_733 | TCCCAAGTGGTCCCCAAAATGTCTTT (SEQ ID NO: 1171) | OBD159_735 | GGGCAGGGTATCTAAGGCAATGGTTC (SEQ ID NO: 1253) |
| 182 | D | OBD159_1121 | GTGCCTCAGTTTTCCTCATCCCTAAG (SEQ ID NO: 1432) | OBD159_1123 | GGGAATGTATGCTGTTCTCAGAG (SEQ ID NO: 1514) |

TABLE 10.a

| | Probe | Genes |
|---|---|---|
| 1 | 7_106136911_106139119_106155635_106157326_RR | CDHR3, NAMPT, SYPL1 |
| 2 | 2_209634852_209638927_209684451_209692640_FF | RPE, MAP2, UNC80 |
| 3 | 2_39607186_39609982_39623225_39627003_FR | MAP4K3, TMEM178A, THUMPD2 |
| 4 | 6_46267215_46269920_46286216_46295988_RF | ENPP4, RCAN2, ENPP5 |
| 5 | 3_120801777_120809148_120844722_120858831_FR | RABL3, STXBP5L, GTF2E1 |
| 6 | 10_3161199_3165742_3210550_3216745_RR | KLF6, PITRM1, PFKP |
| 7 | 2_198099686_198102962_198137324_198146976_RR | MARS2, BOLL, PLCL1 |
| 8 | 12_30144610_30146709_30181629_30184999_RR | CAPRIN2, IPO8, TMTC1 |
| 9 | 19_52224152_52228867_52265664_52267714_RF | ZNF480, ZNF766, PPP2R1A |
| 10 | 6_157189218_157193153_157237058_157240060_RF | ZDHHC14, ARID1B, TMEM242 |
| 11 | 7_106136911_106139119_106183992_106185753_RR | CDHR3, SYPL1, NAMPT |
| 12 | 21_17083642_17087491_17108209_17114129_FF | C21orf91, CXADR, BTG3 |
| 13 | 10_106496977_106502145_106531472_106538179_RF | CFAP58, SORCS1, SORCS3 |
| 14 | 8_31175232_31178937_31205589_31213041_FR | TEX15, WRN, PURG |
| 15 | 13_34426191_34433129_34463898_34472100_FR | MAB21L1, RFC3, NBEA |
| 16 | 5_149610432_149612632_149663575_149665859_RR | PPARGC1B, ARHGEF37, CSNK1A1 |
| 17 | 3_43042539_43050797_43066697_43075829_RF | POMGNT2, FAM198A, RP11-136C24.3 |
| 18 | 14_99794535_99796770_99815362_99818414_RF | HHIPL1, EML1, CYP46A1 |
| 19 | 7_22368712_22370568_22401546_22402661_RR | IL6, RAPGEF5, STEAP1B |
| 20 | 18_58202022_58205094_58215328_58217936_RF | ATP8B1, ALPK2, NEDD4L |

TABLE 10.b

| | Marker | SHAP | Classification |
|---|---|---|---|
| 1 | OBD159.517.519 | 0.57490882 | Healthy Control |
| 2 | OBD159.401.403 | 0.42173229 | Mild |
| 3 | OBD159.089.091 | 0.3262595 | Severe |
| 4 | OBD159.853.855 | 0.31379081 | Severe |
| 5 | OBD159.741.743 | 0.30062315 | Mild |
| 6 | OBD159.657.659 | 0.23915455 | Healthy Control |
| 7 | OBD159.409.411 | 0.22696029 | Severe |
| 8 | OBD159.065.067 | 0.20842332 | Healthy Control |
| 9 | OBD159.389.391 | 0.19269562 | Healthy Control |
| 10 | OBD159.781.783 | 0.19201188 | Healthy Control |
| 11 | OBD159.505.507 | 0.17399292 | Mild |
| 12 | OBD159.669.671 | 0.15368236 | Severe |
| 13 | OBD159.773.775 | 0.15091799 | Healthy Control |
| 14 | OBD159.673.675 | 0.14476814 | Severe |
| 15 | OBD159.073.075 | 0.1442338 | Healthy Control |
| 16 | OBD159.697.699 | 0.1397228 | Mild |
| 17 | OBD159.701.703 | 0.12426417 | Mild |
| 18 | OBD159.833.835 | 0.11698199 | Mild |
| 19 | OBD159.537.539 | 0.09678731 | Mild |
| 20 | OBD159.049.051 | 0.08189849 | Mild |

SEQUENCE LISTING (4696 sequences)

SEQ ID NO: 1 - DNA, 14 bp, Homo sapiens
  misc_feature (6)..(6): n is a, c, g, or t
  misc_feature (9)..(9): n is a, c, g, or t
ccgcgnggnggcag

SEQ ID NO: 2 - DNA, 60 bp, Homo sapiens
gaaacagaatttcaaaaggatactatattcgattgatacatgagttttagtattttttga

SEQ ID NO: 3 - DNA, 60 bp, Homo sapiens; identical to SEQ ID NO: 2

SEQ ID NO: 4 - DNA, 60 bp, Homo sapiens
gcattgtttcttcattttattttatttttcgaagtcttcaagctgactactaaaaattgg

SEQ ID NO: 5 - DNA, 60 bp, Homo sapiens; identical to SEQ ID NO: 4

SEQ ID NO: 6 - DNA, 60 bp, Homo sapiens
cagtaatcctagaaagacaactgatacatcgattttcatttgaaatctttctaatattcc

SEQ ID NO: 7 - DNA, 60 bp, Homo sapiens; identical to SEQ ID NO: 6

SEQ ID NO: 8 - DNA, 60 bp, Homo sapiens
atttttttttattattatacttttaagttcgagctttttgataaaatttgaaaaacacat

SEQ ID NO: 9 - DNA, 60 bp, Homo sapiens; identical to SEQ ID NO: 8

SEQ ID NO: 10 - DNA, 60 bp, Homo sapiens
ataataaacaagcaaaatatgtgtacattcgagatactacgagttaatagcataggagat

SEQ ID NO: 11 - DNA, 60 bp, Homo sapiens; identical to SEQ ID NO: 10

SEQ ID NO: 12 - DNA, 60 bp, Homo sapiens
tattataattgacttatttttccattattcgaatacatttttctctttgagtgggaagaa

SEQ ID NO: 13 - DNA, 60 bp, Homo sapiens; identical to SEQ ID NO: 12

SEQ ID NO: 14 - DNA, 60 bp, Homo sapiens
tatatttaattataattgtaacacaatgtcgatattgaatgacttcatgttgtgaagttg

SEQ ID NO: 15 - DNA, 60 bp, Homo sapiens; identical to SEQ ID NO: 14

SEQ ID NO: 16 - DNA, 60 bp, Homo sapiens
aatgcttaaacaccaagtatatatattttcgatatagtttagttataaccataatcatat

SEQ ID NO: 17 - DNA, 60 bp, Homo sapiens; identical to SEQ ID NO: 16

SEQ ID NO: 18 - DNA, 60 bp, Homo sapiens
ttttcattttttttttaaatatgctatttcgattttctttcatcaggagtaagtttatag

SEQ ID NO: 19 - DNA, 60 bp, Homo sapiens; identical to SEQ ID NO: 18

SEQ ID NO: 20 - DNA, 60 bp, Homo sapiens
ccacggaggggtccttctgaactgcaattcgatgttactctggaaacaaaggtccccttg

SEQ ID NO: 21 - DNA, 60 bp, Homo sapiens; identical to SEQ ID NO: 20

SEQ ID NO: 22 - DNA, 60 bp, Homo sapiens
atatgaaaccaaatatataaacttattttcgattaagaattaccgtcttaagaaaatctc

SEQ ID NO: 23 - DNA, 60 bp, Homo sapiens; identical to SEQ ID NO: 22

SEQ ID NO: 24 - DNA, 60 bp, Homo sapiens
attttttttagccctatcttcacaggtatcgactaaatacttcttcagtaattactgaaa

SEQ ID NO: 25 - DNA, 60 bp, Homo sapiens; identical to SEQ ID NO: 24

SEQ ID NO: 26 - DNA, 60 bp, Homo sapiens
atattaccttatttggaaacagtttcattcgagtggctcaaatgattatttttatagttt

SEQ ID NO: 27 - DNA, 60 bp, Homo sapiens; identical to SEQ ID NO: 26

SEQ ID NO: 28 - DNA, 60 bp, Homo sapiens
acttgcttctataaacattattgtaagatcgagactcaaaatcatttgactcttctacaa

SEQ ID NO: 29 - DNA, 60 bp, Homo sapiens; identical to SEQ ID NO: 28

SEQ ID NO: 30 - DNA, 60 bp, Homo sapiens
ctatagaaattaaaataatattaagagttcgattattctgctatacttttctcattataa

SEQ ID NO: 31 - DNA, 60 bp, Homo sapiens; identical to SEQ ID NO: 30

SEQ ID NO: 32 - DNA, 60 bp, Homo sapiens
actaaatttattttaactttttttttaatcgagagtttttatagcacttactctgagtct

SEQ ID NO: 33 - DNA, 60 bp, Homo sapiens; identical to SEQ ID NO: 32

SEQ ID NO: 34 - DNA, 60 bp, Homo sapiens
atgtaaagaatttaaaaataatcagttgtcgagattatttttcaattttgggtgctcttc

SEQ ID NO: 35 - DNA, 60 bp, Homo sapiens; identical to SEQ ID NO: 34

SEQ ID NO: 36 - DNA, 60 bp, Homo sapiens
tacctttaacaaaattctctagactttttcgatttacattctgttgtttcattgcattat

SEQ ID NO: 37 - DNA, 60 bp, Homo sapiens; identical to SEQ ID NO: 36

SEQ ID NO: 38 - DNA, 60 bp, Homo sapiens
atattggtagaataatagtagatactattcgaatggtatatcctcatagttttaatctgt

SEQ ID NO: 39 - DNA, 60 bp, Homo sapiens; identical to SEQ ID NO: 38

SEQ ID NO: 40 - DNA, 60 bp, Homo sapiens
tatatggtacatattatacatatttctatcgatttttacaagaaatttaaaaattagctt

SEQ ID NO: 41 - DNA, 60 bp, Homo sapiens; identical to SEQ ID NO: 40

SEQ ID NO: 42 - DNA, 60 bp, Homo sapiens
atccagatgacctaaaatatgtttattttcgaaacaatctcatttgacagatgaagaaac

SEQ ID NO: 43 - DNA, 60 bp, Homo sapiens; identical to SEQ ID NO: 42

SEQ ID NO: 44 - DNA, 60 bp, Homo sapiens
aactctgtattttcttttgtaagattcatcgatcaataaatctttaatcacattcacaaa

SEQ ID NO: 45 - DNA, 60 bp, Homo sapiens; identical to SEQ ID NO: 44

SEQ ID NO: 46 - DNA, 60 bp, Homo sapiens
cataaataaacacatgaaatatatgaaatcgaaattaaccagaaatccgagaacctgaaa

SEQ ID NO: 47 - DNA, 60 bp, Homo sapiens; identical to SEQ ID NO: 46

SEQ ID NO: 48 - DNA, 60 bp, Homo sapiens
cataaataaacacatgaaatatatgaaatcgaaaactaaatctctaatctctaacctttc

SEQ ID NO: 49 - DNA, 60 bp, Homo sapiens; identical to SEQ ID NO: 48

SEQ ID NO: 50 - DNA, 60 bp, Homo sapiens
tatctagatgtaggtatatatttatctatcgatatctctgttttcttttgactggtggtt

SEQ ID NO: 51 - DNA, 60 bp, Homo sapiens; identical to SEQ ID NO: 50

SEQ ID NO: 52 - DNA, 60 bp, Homo sapiens
ccacggaggggtccttctgaactgcaattcgaagtgaaactgcctttgatgggctcatca

SEQ ID NO: 53 - DNA, 60 bp, Homo sapiens; identical to SEQ ID NO: 52

SEQ ID NO: 54 - DNA, 26 bp, Homo sapiens
cttctggagtcactttctcttttaga

SEQ ID NO: 55 - DNA, 26 bp, Homo sapiens
cttctggagtcactttctcttttaga

SEQ ID NO: 56 - DNA, 26 bp, Homo sapiens
ctgaagttgtagcaggcagcatccat

SEQ ID NO: 57 - DNA, 26 bp, Homo sapiens
ctgaagttgtagcaggcagcatccat

SEQ ID NO: 58 - DNA, 24 bp, Homo sapiens
ggtgaggcttctgttttcgggagg

SEQ ID NO: 59 - DNA, 24 bp, Homo sapiens
ggtgaggcttctgttttcgggagg

SEQ ID NO: 60 - DNA, 23 bp, Homo sapiens
gtttcaggaccaccctctacacc

SEQ ID NO: 61 - DNA, 23 bp, Homo sapiens
gtttcaggaccaccctctacacc

SEQ ID NO: 62 - DNA, 26 bp, Homo sapiens
ctgttctgggtgcttgggatagatgc

SEQ ID NO: 63 - DNA, 26 bp, Homo sapiens
ctgttctgggtgcttgggatagatgc

SEQ ID NO: 64 - DNA, 23 bp, Homo sapiens
gtgcccttcgcctaaacacaagc

SEQ ID NO: 65 - DNA, 23 bp, Homo sapiens
gtgcccttcgcctaaacacaagc

SEQ ID NO: 66 - DNA, 23 bp, Homo sapiens
caacctaacacaacatagcctgc

SEQ ID NO: 67 - DNA, 23 bp, Homo sapiens
caacctaacacaacatagcctgc

SEQ ID NO: 68 - DNA, 20 bp, Homo sapiens
tctgactgaacacatatgct

SEQ ID NO: 69 - DNA, 20 bp, Homo sapiens
tctgactgaacacatatgct

SEQ ID NO: 70 - DNA, 26 bp, Homo sapiens
gtgaaaccaccagagtagtcaggaag

SEQ ID NO: 71 - DNA, 26 bp, Homo sapiens
gtgaaaccaccagagtagtcaggaag

SEQ ID NO: 72 - DNA, 23 bp, Homo sapiens
gccagaagttcacaggcagggtg

SEQ ID NO: 73 - DNA, 23 bp, Homo sapiens
gccagaagttcacaggcagggtg

SEQ ID NO: 74 - DNA, 23 bp, Homo sapiens
ccctcaggcttctgttgttggca

SEQ ID NO: 75 - DNA, 23 bp, Homo sapiens
ccctcaggcttctgttgttggca

SEQ ID NO: 76 - DNA, 23 bp, Homo sapiens
gttgctgccagagacccatccca

SEQ ID NO: 77 - DNA, 23 bp, Homo sapiens
gttgctgccagagacccatccca

SEQ ID NO: 78 - DNA, 26 bp, Homo sapiens
ggagagtattatggattgagtggtct

SEQ ID NO: 79 - DNA, 26 bp, Homo sapiens
ggagagtattatggattgagtggtct

SEQ ID NO: 80 - DNA, 23 bp, Homo sapiens
ccacttgccctgtgctcgccagc

SEQ ID NO: 81 - DNA, 23 bp, Homo sapiens
ccacttgccctgtgctcgccagc

SEQ ID NO: 82 - DNA, 26 bp, Homo sapiens
gacatttggtgacccattactcaaca

SEQ ID NO: 83 - DNA, 26 bp, Homo sapiens
gacatttggtgacccattactcaaca

SEQ ID NO: 84 - DNA, 23 bp, Homo sapiens
ggcgggtgggtatgtgttatggg

SEQ ID NO: 85 - DNA, 23 bp, Homo sapiens
ggcgggtgggtatgtgttatggg

SEQ ID NO: 86 - DNA, 24 bp, Homo sapiens
tttggcaaggcatagaatagaata

SEQ ID NO: 87 - DNA, 24 bp, Homo sapiens
tttggcaaggcatagaatagaata

SEQ ID NO: 88 - DNA, 24 bp, Homo sapiens
gtgtcacaataaaatggcataaaa

SEQ ID NO: 89 - DNA, 24 bp, Homo sapiens
gtgtcacaataaaatggcataaaa

SEQ ID NO: 90 - DNA, 24 bp, Homo sapiens
tctctttcattgagttctaagtta

SEQ ID NO: 91 - DNA, 24 bp, Homo sapiens
tctctttcattgagttctaagtta

SEQ ID NO: 92 - DNA, 24 bp, Homo sapiens
catttgtcaactcacactctaaaa

SEQ ID NO: 93 - DNA, 24 bp, Homo sapiens
catttgtcaactcacactctaaaa

SEQ ID NO: 94 - DNA, 26 bp, Homo sapiens
ggtgttacttggcttctatgccttag

SEQ ID NO: 95 - DNA, 26 bp, Homo sapiens
ggtgttacttggcttctatgccttag

SEQ ID NO: 96 - DNA, 26 bp, Homo sapiens
tgaaatgagcaggtgggagtaggtgg

SEQ ID NO: 97 - DNA, 26 bp, Homo sapiens
tgaaatgagcaggtgggagtaggtgg

SEQ ID NO: 98 - DNA, 26 bp, Homo sapiens
tatgaaatgtaggaatgctgtccctc

SEQ ID NO: 99 - DNA, 26 bp, Homo sapiens
tatgaaatgtaggaatgctgtccctc

SEQ ID NO: 100 - DNA, 26 bp, Homo sapiens
tatgaaatgtaggaatgctgtccctc

SEQ ID NO: 101 - DNA, 26 bp, Homo sapiens
tatgaaatgtaggaatgctgtccctc

SEQ ID NO: 102 - DNA, 26 bp, Homo sapiens
ctgttctcagcaatggaatctcaggt

SEQ ID NO: 103 - DNA, 26 bp, Homo sapiens
ctgttctcagcaatggaatctcaggt

SEQ ID NO: 104 - DNA, 26 bp, Homo sapiens
cagaagttcacaggcagggtgtcttg

SEQ ID NO: 105 - DNA, 26 bp, Homo sapiens
cagaagttcacaggcagggtgtcttg

SEQ ID NO: 106 - DNA, 23 bp, Homo sapiens
agcctgggcgacagagtgagact

SEQ ID NO: 107 - DNA, 23 bp, Homo sapiens
agcctgggcgacagagtgagact

SEQ ID NO: 108 - DNA, 26 bp, Homo sapiens
gaggttttgtcacagcgaagcagtca

SEQ ID NO: 109 - DNA, 26 bp, Homo sapiens
gaggttttgtcacagcgaagcagtca

SEQ ID NO: 110 - DNA, 23 bp, Homo sapiens
aggatttgggtccctggtctcca

SEQ ID NO: 111 - DNA, 23 bp, Homo sapiens
aggatttgggtccctggtctcca

SEQ ID NO: 112 - DNA, 24 bp, Homo sapiens
ccagttcttcccttccagagcagg

SEQ ID NO: 113 - DNA, 24 bp, Homo sapiens
ccagttcttcccttccagagcagg

SEQ ID NO: 114 - DNA, 26 bp, Homo sapiens
tttgtgcttcttgctgtgtgtgtgtg

SEQ ID NO: 115 - DNA, 26 bp, Homo sapiens
tttgtgcttcttgctgtgtgtgtgtg

SEQ ID NO: 116 - DNA, 23 bp, Homo sapiens
gagactctgacccgtcccctgat

SEQ ID NO: 117 - DNA, 23 bp, Homo sapiens
gagactctgacccgtcccctgat

SEQ ID NO: 118 - DNA, 26 bp, Homo sapiens
caagtgactccattttggttgtgaca

SEQ ID NO: 119 - DNA, 26 bp, Homo sapiens
caagtgactccattttggttgtgaca

SEQ ID NO: 120 - DNA, 19 bp, Homo sapiens
aataccaacaataatttgt

SEQ ID NO: 121 - DNA, 19 bp, Homo sapiens
aataccaacaataatttgt

SEQ ID NO: 122 - DNA, 25 bp, Homo sapiens
gaaagtggtcttcctccgcctctat

SEQ ID NO: 123 - DNA, 25 bp, Homo sapiens
gaaagtggtcttcctccgcctctat

SEQ ID NO: 124 - DNA, 23 bp, Homo sapiens
gcccaactctgcctgctgaaatc

SEQ ID NO: 125 - DNA, 23 bp, Homo sapiens
gcccaactctgcctgctgaaatc

SEQ ID NO: 126 - DNA, 23 bp, Homo sapiens
gcaggtattgccagccacagcgt

SEQ ID NO: 127 - DNA, 23 bp, Homo sapiens
gcaggtattgccagccacagcgt

SEQ ID NO: 128 - DNA, 23 bp, Homo sapiens
cggtagcaccagccgatgaactt

SEQ ID NO: 129 - DNA, 23 bp, Homo sapiens
cggtagcaccagccgatgaactt

SEQ ID NO: 130 - DNA, 26 bp, Homo sapiens
ctctaagccttgacttccctatcagc

SEQ ID NO: 131 - DNA, 26 bp, Homo sapiens
ctctaagccttgacttccctatcagc

SEQ ID NO: 132 - DNA, 26 bp, Homo sapiens
gagaaaatcttgaatgggaatccagt

SEQ ID NO: 133 - DNA, 26 bp, Homo sapiens
gagaaaatcttgaatgggaatccagt

SEQ ID NO: 134 - DNA, 26 bp, Homo sapiens
ggaggcatttggcttgtccccagatt

SEQ ID NO: 135 - DNA, 26 bp, Homo sapiens
ggaggcatttggcttgtccccagatt

SEQ ID NO: 136 - DNA, 23 bp, Homo sapiens
ggtcttcattcctggttcctggc

SEQ ID NO: 137 - DNA, 23 bp, Homo sapiens
ggtcttcattcctggttcctggc

SEQ ID NO: 138 - DNA, 24 bp, Homo sapiens
tttggcaaggcatagaatagaata

SEQ ID NO: 139 - DNA, 24 bp, Homo sapiens
tttggcaaggcatagaatagaata

SEQ ID NO: 140 - DNA, 24 bp, Homo sapiens
catcccattctcagcatttgatta

SEQ ID NO: 141 - DNA, 24 bp, Homo sapiens
catcccattctcagcatttgatta

SEQ ID NO: 142 - DNA, 24 bp, Homo sapiens
tgagattgtgccactgaactccag

SEQ ID NO: 143 - DNA, 24 bp, Homo sapiens
tgagattgtgccactgaactccag

SEQ ID NO: 144 - DNA, 25 bp, Homo sapiens
tggtttactgctgtagccttgacct

SEQ ID NO: 145 - DNA, 25 bp, Homo sapiens
tggtttactgctgtagccttgacct

SEQ ID NO: 146 - DNA, 26 bp, Homo sapiens
gctgcttagggacaccgaaaaggttc

SEQ ID NO: 147 - DNA, 26 bp, Homo sapiens
gctgcttagggacaccgaaaaggttc

SEQ ID NO: 148 - DNA, 26 bp, Homo sapiens
cggaaaatgaggaagagaggaggata

SEQ ID NO: 149 - DNA, 26 bp, Homo sapiens
cggaaaatgaggaagagaggaggata

SEQ ID NO: 150 - DNA, 26 bp, Homo sapiens
ggttcgtgtaacagccagttcattta

SEQ ID NO: 151 - DNA, 26 bp, Homo sapiens
ggttcgtgtaacagccagttcattta

SEQ ID NO: 152 - DNA, 23 bp, Homo sapiens
ccaggctacacagacatagttgt

SEQ ID NO: 153 - DNA, 23 bp, Homo sapiens
ccaggctacacagacatagttgt

SEQ ID NO: 154 - DNA, 26 bp, Homo sapiens
caataactgaatggctgagtctgaaa

SEQ ID NO: 155 - DNA, 26 bp, Homo sapiens
caataactgaatggctgagtctgaaa

SEQ ID NO: 156 - DNA, 26 bp, Homo sapiens
catttggaatcttctcacggttgctg

SEQ ID NO: 157 - DNA, 26 bp, Homo sapiens
catttggaatcttctcacggttgctg

SEQ ID NO: 158 - DNA, 60 bp, Homo sapiens
ccacggaggggtccttctgaactgcaattcgaaacagtattttcaaaaataaaatagacc

SEQ ID NO: 159 - DNA, 60 bp, Homo sapiens; identical to SEQ ID NO: 158

SEQ ID NO: 160 - DNA, 60 bp, Homo sapiens
aaaggaaatattaagtatggaaatactttcgacacacaattatgacactactagtaatag

SEQ ID NO: 161 - DNA, 60 bp, Homo sapiens; identical to SEQ ID NO: 160

SEQ ID NO: 162 - DNA, 60 bp, Homo sapiens
caattcagataataatacttttataatgtcgacagagctacattaaaaaggagaatctcc

SEQ ID NO: 163 - DNA, 60 bp, Homo sapiens; identical to SEQ ID NO: 162

SEQ ID NO: 164 - DNA, 60 bp, Homo sapiens
gcccactaaatagtaatattaggatctatcgatttcccacatggaatatacagatttagc

SEQ ID NO: 165 - DNA, 60 bp, Homo sapiens; identical to SEQ ID NO: 164

SEQ ID NO: 166 - DNA, 60 bp, Homo sapiens
caagaagaagggataaaatactacttcttcgaaagtgacaataacctccataattaaggg

SEQ ID NO: 167 - DNA, 60 bp, Homo sapiens; identical to SEQ ID NO: 166

SEQ ID NO: 168 - DNA, 60 bp, Homo sapiens
ttatatgttttaaataacaaaaattatatcgatcatctatctacatgtgtgtatctctat

SEQ ID NO: 169 - DNA, 60 bp, Homo sapiens; identical to SEQ ID NO: 168

SEQ ID NO: 170 - DNA, 60 bp, Homo sapiens
caagaagaagggataaaatactacttcttcgagataatttgagattaaattgacaacata

SEQ ID NO: 171 - DNA, 60 bp, Homo sapiens; identical to SEQ ID NO: 170

SEQ ID NO: 172 - DNA, 60 bp, Homo sapiens
ggaaataaacagagggattttgtttatatcgattatcttacatgtttcttagaatgaatg

SEQ ID NO: 173 - DNA, 60 bp, Homo sapiens; identical to SEQ ID NO: 172

SEQ ID NO: 174 - DNA, 60 bp, Homo sapiens
tagatgaataaatttagaccttattaggtcgaaaaaactggaaaaaaaaattgtcaagtg

SEQ ID NO: 175 - DNA, 60 bp, Homo sapiens; identical to SEQ ID NO: 174

SEQ ID NO: 176 - DNA, 60 bp, Homo sapiens
ctactcttattcttctctcaagaaattatcgatgtttgagaaatatacaaataaagtaat

SEQ ID NO: 177 - DNA, 60 bp, Homo sapiens; identical to SEQ ID NO: 176

SEQ ID NO: 178 - DNA, 60 bp, Homo sapiens
caatattatatgtagagattctttcatatcgattaagaattaccgtcttaagaaaatctc

SEQ ID NO: 179 - DNA, 60 bp, Homo sapiens; identical to SEQ ID NO: 178

SEQ ID NO: 180 - DNA, 60 bp, Homo sapiens
agcacaaaataatatagcataaaacatatcgacttatctgattttcacctcaaatgacct

SEQ ID NO: 181 - DNA, 60 bp, Homo sapiens; identical to SEQ ID NO: 180

SEQ ID NO: 182 - DNA, 60 bp, Homo sapiens
tatttgtaaatattttagtatttacaaatcgattttcataatatcctaaatatgatatag

SEQ ID NO: 183 - DNA, 60 bp, Homo sapiens; identical to SEQ ID NO: 182

SEQ ID NO: 184 - DNA, 60 bp, Homo sapiens
tacatttttagctcatcataaaagatattcgattatttagaaaaagaaatgaagagatgg

SEQ ID NO: 185 - DNA, 60 bp, Homo sapiens; identical to SEQ ID NO: 184

SEQ ID NO: 186 - DNA, 60 bp, Homo sapiens
atgaaatagagtgttagaatttaatgaatcgaactgattaataattttcttctgaacccc

SEQ ID NO: 187 - DNA, 60 bp, Homo sapiens; identical to SEQ ID NO: 186

SEQ ID NO: 188 - DNA, 60 bp, Homo sapiens
tggtaaattggagcaggtgacctgggagtcgaggcagctgcaggatttaaattggctgag

SEQ ID NO: 189 - DNA, 60 bp, Homo sapiens; identical to SEQ ID NO: 188

SEQ ID NO: 190 - DNA, 60 bp, Homo sapiens
ttaacatcttattctaaaaaatagtttatcgaaaaatcagaaatcagtaacctaatactg

SEQ ID NO: 191 - DNA, 60 bp, Homo sapiens; identical to SEQ ID NO: 190

SEQ ID NO: 192 - DNA, 60 bp, Homo sapiens
ggtaatatttaactatagttctcaatactcgagtgataaatattttgccaacttataagg

SEQ ID NO: 193 - DNA, 60 bp, Homo sapiens; identical to SEQ ID NO: 192

SEQ ID NO: 194 - DNA, 60 bp, Homo sapiens
ttttctcagctaagaaaacaaatgagattcgagtcattaattcttgcttcttaactgctt

SEQ ID NO: 195 - DNA, 60 bp, Homo sapiens; identical to SEQ ID NO: 194

SEQ ID NO: 196 - DNA, 60 bp, Homo sapiens
aaagatataatgtttcacatattttaaatcgatatattctacaaactgctttattgtaga

SEQ ID NO: 197 - DNA, 60 bp, Homo sapiens; identical to SEQ ID NO: 196

SEQ ID NO: 198 - DNA, 60 bp, Homo sapiens
ccacggaggggtccttctgaactgcaattcgacatccaaggtcttcacaatgtggctgac

SEQ ID NO: 199 - DNA, 60 bp, Homo sapiens; identical to SEQ ID NO: 198

SEQ ID NO: 200 - DNA, 60 bp, Homo sapiens
cacacttgagctcattgtaaaccaaagctcgagagcggtcccgtgggggcggtgttactc

SEQ ID NO: 201 - DNA, 60 bp, Homo sapiens; identical to SEQ ID NO: 200

SEQ ID NO: 202 - DNA, 60 bp, Homo sapiens
aaaggaaatattaagtatggaaatactttcgagaaagaaacaaatacagctaggaagcat

SEQ ID NO: 203 - DNA, 60 bp, Homo sapiens; identical to SEQ ID NO: 202

SEQ ID NO: 204 - DNA, 60 bp, Homo sapiens
aattattcaaaaagacacaattgttttctcgaacatgttttagtgatttatattcactca

SEQ ID NO: 205 - DNA, 60 bp, Homo sapiens; identical to SEQ ID NO: 204

SEQ ID NO: 206 - DNA, 60 bp, Homo sapiens
aattccatattttctagaaaacaaaaaatcgattttagaagacttgaaaaagttgtaatt

SEQ ID NO: 207 - DNA, 60 bp, Homo sapiens; identical to SEQ ID NO: 206

SEQ ID NO: 208 - DNA, 60 bp, Homo sapiens
aaactatgtaaagaaaatttgaagaatttcgatttttattgccagaaacgactcttaaag

SEQ ID NO: 209 - DNA, 60 bp, Homo sapiens; identical to SEQ ID NO: 208

SEQ ID NO: 210 - DNA, 60 bp, Homo sapiens
catgtatttatattaatatcaaacaagatcgaccattataaagatttaactattttatgc

SEQ ID NO: 211 - DNA, 60 bp, Homo sapiens; identical to SEQ ID NO: 210

SEQ ID NO: 212 - DNA, 60 bp, Homo sapiens
atttttttttattattatacttttaagttcgaatctttctaaaacacagtaaactcaaac

SEQ ID NO: 213 - DNA, 60 bp, Homo sapiens; identical to SEQ ID NO: 212

SEQ ID NO: 214 - DNA, 60 bp, Homo sapiens
tatgtatttatatatgattaccattatgtcgatgaatcaacattttccaaaataatacat

SEQ ID NO: 215 - DNA, 60 bp, Homo sapiens; identical to SEQ ID NO: 214

SEQ ID NO: 216 - DNA, 60 bp, Homo sapiens
ccaatatgtattcaaattaaatacgtattcgactttatactatatgagaataaaaaaaga

SEQ ID NO: 217 - DNA, 60 bp, Homo sapiens; identical to SEQ ID NO: 216

SEQ ID NO: 218 - DNA, 23 bp, Homo sapiens
gccagaagttcacaggcagggtg

SEQ ID NO: 219 - DNA, 23 bp, Homo sapiens
gccagaagttcacaggcagggtg

SEQ ID NO: 220 - DNA, 23 bp, Homo sapiens
ttacaggcgtgagccaccaagcc

SEQ ID NO: 221 - DNA, 23 bp, Homo sapiens
ttacaggcgtgagccaccaagcc

SEQ ID NO: 222 - DNA, 26 bp, Homo sapiens
atggcgaacagagtgatggaggtgat

SEQ ID NO: 223 - DNA, 26 bp, Homo sapiens
atggcgaacagagtgatggaggtgat

SEQ ID NO: 224 - DNA, 24 bp, Homo sapiens
ccagtagtatggtggctgtgaata

SEQ ID NO: 225 - DNA, 24 bp, Homo sapiens
ccagtagtatggtggctgtgaata

SEQ ID NO: 226 - DNA, 23 bp, Homo sapiens
gagggagagagactgaaggcagg

SEQ ID NO: 227 - DNA, 23 bp, Homo sapiens
gagggagagagactgaaggcagg

SEQ ID NO: 228 - DNA, 26 bp, Homo sapiens
tcaccctctgcctctgtgttctcatc

SEQ ID NO: 229 - DNA, 26 bp, Homo sapiens
tcaccctctgcctctgtgttctcatc

SEQ ID NO: 230 - DNA, 26 bp, Homo sapiens
ggagagagactgaaggcaggaatgct

SEQ ID NO: 231 - DNA, 26 bp, Homo sapiens
ggagagagactgaaggcaggaatgct

SEQ ID NO: 232 - DNA, 24 bp, Homo sapiens
gaaaataacttggacttcagtgtt

SEQ ID NO: 233 - DNA, 24 bp, Homo sapiens
gaaaataacttggacttcagtgtt

SEQ ID NO: 234 - DNA, 23 bp, Homo sapiens
actcagtcccctccctcagtagc

SEQ ID NO: 235 - DNA, 23 bp, Homo sapiens
actcagtcccctccctcagtagc

SEQ ID NO: 236 - DNA, 24 bp, Homo sapiens
acaggtaggtaaacatttcataaa

SEQ ID NO: 237 - DNA, 24 bp, Homo sapiens
acaggtaggtaaacatttcataaa

SEQ ID NO: 238 - DNA, 26 bp, Homo sapiens
ccattcttccagagatgtcaaaaccc

SEQ ID NO: 239 - DNA, 26 bp, Homo sapiens
ccattcttccagagatgtcaaaaccc

SEQ ID NO: 240 - DNA, 26 bp, Homo sapiens
gctcctgccattcagtttaccatcta

SEQ ID NO: 241 - DNA, 26 bp, Homo sapiens
gctcctgccattcagtttaccatcta

SEQ ID NO: 242 - DNA, 26 bp, Homo sapiens
atacagccacttcaacttgtcctaat

SEQ ID NO: 243 - DNA, 26 bp, Homo sapiens
atacagccacttcaacttgtcctaat

SEQ ID NO: 244 - DNA, 23 bp, Homo sapiens
tgctgtgtgaccttgggatgtcc

SEQ ID NO: 245 - DNA, 23 bp, Homo sapiens
tgctgtgtgaccttgggatgtcc

SEQ ID NO: 246 - DNA, 26 bp, Homo sapiens
ggtcagtgtcaagcagtccaatgagt

SEQ ID NO: 247 - DNA, 26 bp, Homo sapiens
ggtcagtgtcaagcagtccaatgagt

SEQ ID NO: 248 - DNA, 23 bp, Homo sapiens
gaagcgagttgctgtcactggag

SEQ ID NO: 249 - DNA, 23 bp, Homo sapiens
gaagcgagttgctgtcactggag

SEQ ID NO: 250 - DNA, 24 bp, Homo sapiens
gggacacaaatagaccaagtaaat

SEQ ID NO: 251 - DNA, 24 bp, Homo sapiens
gggacacaaatagaccaagtaaat

SEQ ID NO: 252 - DNA, 23 bp, Homo sapiens
ggtgaaatgggatggtgtgctat

SEQ ID NO: 253 - DNA, 23 bp, Homo sapiens
ggtgaaatgggatggtgtgctat

SEQ ID NO: 254 - DNA, 24 bp, Homo sapiens
cataaactcctaccaactaagaat

SEQ ID NO: 255 - DNA, 24 bp, Homo sapiens
cataaactcctaccaactaagaat

SEQ ID NO: 256 - DNA, 24 bp, Homo sapiens
aataaatagataccatcccagagc

SEQ ID NO: 257 - DNA, 24 bp, Homo sapiens
aataaatagataccatcccagagc

SEQ ID NO: 258 - DNA, 23 bp, Homo sapiens
cagaagttcacaggcagggtgtc

SEQ ID NO: 259 - DNA, 23 bp, Homo sapiens
cagaagttcacaggcagggtgtc

SEQ ID NO: 260 - DNA, 24 bp, Homo sapiens
caggaatcatttgacacaatcccc

SEQ ID NO: 261 - DNA, 24 bp, Homo sapiens
caggaatcatttgacacaatcccc

SEQ ID NO: 262 - DNA, 25 bp, Homo sapiens
aaacaactactatcagatgagaaat

SEQ ID NO: 263 - DNA, 25 bp, Homo sapiens
aaacaactactatcagatgagaaat

SEQ ID NO: 264 - DNA, 26 bp, Homo sapiens
ggatgtgtgtgttgattcagccttgt

SEQ ID NO: 265 - DNA, 26 bp, Homo sapiens
ggatgtgtgtgttgattcagccttgt

SEQ ID NO: 266 - DNA, 26 bp, Homo sapiens
ctctacctgtattgttggctaatcaa

SEQ ID NO: 267 - DNA, 26 bp, Homo sapiens
ctctacctgtattgttggctaatcaa

SEQ ID NO: 268 - DNA, 26 bp, Homo sapiens
ggcaaaagatttattagggacaacca

SEQ ID NO: 269 - DNA, 26 bp, Homo sapiens
ggcaaaagatttattagggacaacca

SEQ ID NO: 270 - DNA, 26 bp, Homo sapiens
cagaaatgtcaaaagtaagaggcaag

SEQ ID NO: 271 - DNA, 26 bp, Homo sapiens
cagaaatgtcaaaagtaagaggcaag

SEQ ID NO: 272 - DNA, 26 bp, Homo sapiens
ggtttcaggaccaccctctacaccaa

SEQ ID NO: 273 - DNA, 26 bp, Homo sapiens
ggtttcaggaccaccctctacaccaa

SEQ ID NO: 274 - DNA, 23 bp, Homo sapiens
acatatattaatataataatgta

SEQ ID NO: 275 - DNA, 23 bp, Homo sapiens
acatatattaatataataatgta

SEQ ID NO: 276 - DNA, 26 bp, Homo sapiens
gagcagaacagaaaggaacttgagta

SEQ ID NO: 277 - DNA, 26 bp, Homo sapiens
gagcagaacagaaaggaacttgagta

SEQ ID NO: 278 - DNA, 23 bp, Homo sapiens
gcccttgccctgtctcagaatct

SEQ ID NO: 279 - DNA, 23 bp, Homo sapiens
gcccttgccctgtctcagaatct

SEQ ID NO: 280 - DNA, 23 bp, Homo sapiens
cagatgttggtttagatgctggg

SEQ ID NO: 281 - DNA, 23 bp, Homo sapiens
cagatgttggtttagatgctggg

SEQ ID NO: 282 - DNA, 26 bp, Homo sapiens
ttctgtggaggacctgggaaatactc

SEQ ID NO: 283 - DNA, 26 bp, Homo sapiens
ttctgtggaggacctgggaaatactc

SEQ ID NO: 284 - DNA, 24 bp, Homo sapiens
ccagaaagaatgatgaatgtgttc

SEQ ID NO: 285 - DNA, 24 bp, Homo sapiens
ccagaaagaatgatgaatgtgttc

SEQ ID NO: 286 - DNA, 24 bp, Homo sapiens
gctggctgtcctctaaaactctta

SEQ ID NO: 287 - DNA, 24 bp, Homo sapiens
gctggctgtcctctaaaactctta

SEQ ID NO: 288 - DNA, 26 bp, Homo sapiens
cccattggcattcagtagaacacttc

SEQ ID NO: 289 - DNA, 26 bp, Homo sapiens
cccattggcattcagtagaacacttc

SEQ ID NO: 290 - DNA, 26 bp, Homo sapiens
gattgaaggagagagactaaagacgc

SEQ ID NO: 291 - DNA, 26 bp, Homo sapiens
gattgaaggagagagactaaagacgc

SEQ ID NO: 292 - DNA, 24 bp, Homo sapiens
ttcagtcaatcctttcagagaata

SEQ ID NO: 293 - DNA, 24 bp, Homo sapiens
ttcagtcaatcctttcagagaata

SEQ ID NO: 294 - DNA, 23 bp, Homo sapiens
gagtgggttgggcagattaggca

SEQ ID NO: 295 - DNA, 23 bp, Homo sapiens
gagtgggttgggcagattaggca

SEQ ID NO: 296 - DNA, 25 bp, Homo sapiens
atctcaggtaacttgattcacaaag

SEQ ID NO: 297 - DNA, 25 bp, Homo sapiens
atctcaggtaacttgattcacaaag

SEQ ID NO: 298 - DNA, 26 bp, Homo sapiens
caggtattgccagccacagcgtttga

SEQ ID NO: 299 - DNA, 26 bp, Homo sapiens
caggtattgccagccacagcgtttga

SEQ ID NO: 300 - DNA, 26 bp, Homo sapiens
gactcaaacagtaaaatagggcacca

SEQ ID NO: 301 - DNA, 26 bp, Homo sapiens
gactcaaacagtaaaatagggcacca

SEQ ID NO: 302 - DNA, 26 bp, Homo sapiens
gcaagtgctcatctctaaacaacaac

SEQ ID NO: 303 - DNA, 26 bp, Homo sapiens
gcaagtgctcatctctaaacaacaac

SEQ ID NO: 304 - DNA, 23 bp, Homo sapiens
ctccctttcccagtttgagcccc

SEQ ID NO: 305 - DNA, 23 bp, Homo sapiens
ctccctttcccagtttgagcccc

SEQ ID NO: 306 - DNA, 26 bp, Homo sapiens
tttatgagagtgtggacaaaataggg

SEQ ID NO: 307 - DNA, 26 bp, Homo sapiens
tttatgagagtgtggacaaaataggg

SEQ ID NO: 308 - DNA, 24 bp, Homo sapiens
ccccaacacaaactgtcctcaggc

SEQ ID NO: 309 - DNA, 24 bp, Homo sapiens
ccccaacacaaactgtcctcaggc

SEQ ID NO: 310 - DNA, 25 bp, Homo sapiens
gtttcacttagttctattctgattt

SEQ ID NO: 311 - DNA, 25 bp, Homo sapiens
gtttcacttagttctattctgattt

SEQ ID NO: 312 - DNA, 23 bp, Homo sapiens
agcctgggtaacagagtgagact

SEQ ID NO: 313 - DNA, 23 bp, Homo sapiens
agcctgggtaacagagtgagact

SEQ ID NO: 314 - DNA, 24 bp, Homo sapiens
agagtgttgactgatgaagggctc

SEQ ID NO: 315 - DNA, 24 bp, Homo sapiens
agagtgttgactgatgaagggctc

SEQ ID NO: 316 - DNA, 24 bp, Homo sapiens
ctaacatttcttttctccacagta

SEQ ID NO: 317 - DNA, 24 bp, Homo sapiens
ctaacatttcttttctccacagta

SEQ ID NO: 318 - DNA, 23 bp, Homo sapiens
tttggctggagcacggagtctgc

SEQ ID NO: 319 - DNA, 23 bp, Homo sapiens
tttggctggagcacggagtctgc

SEQ ID NO: 320 - DNA, 23 bp, Homo sapiens
ctccacttctaccaccacgagta

SEQ ID NO: 321 - DNA, 23 bp, Homo sapiens
ctccacttctaccaccacgagta

SEQ ID NO: 322 - DNA, 24 bp, Homo sapiens
tttctggagcattgtatgtcaact

SEQ ID NO: 323 - DNA, 24 bp, Homo sapiens
tttctggagcattgtatgtcaact

SEQ ID NO: 324 - DNA, 26 bp, Homo sapiens
gatgactgttttcagagacaatggaa

SEQ ID NO: 325 - DNA, 26 bp, Homo sapiens
gatgactgttttcagagacaatggaa

SEQ ID NO: 326 - DNA, 23 bp, Homo sapiens
ttttcctgtcagtgaacaccgtg

SEQ ID NO: 327 - DNA, 23 bp, Homo sapiens
ttttcctgtcagtgaacaccgtg

SEQ ID NO: 328 - DNA, 26 bp, Homo sapiens
ttggcataaagcagggctccaggaat

SEQ ID NO: 329 - DNA, 26 bp, Homo sapiens
ttggcataaagcagggctccaggaat

SEQ ID NO: 330 - DNA, 26 bp, Homo sapiens
gcttcctctgccccatctacaaacat

SEQ ID NO: 331 - DNA, 26 bp, Homo sapiens
gcttcctctgccccatctacaaacat

SEQ ID NO: 332 - DNA, 26 bp, Homo sapiens
cctacccaaataagactcatcccaac

SEQ ID NO: 333 - DNA, 26 bp, Homo sapiens
cctacccaaataagactcatcccaac

SEQ ID NO: 334 - DNA, 20 bp, Homo sapiens
ttgcaactaaccatgaagaa

SEQ ID NO: 335 - DNA, 20 bp, Homo sapiens
ttgcaactaaccatgaagaa

SEQ ID NO: 336 - DNA, 26 bp, Homo sapiens
tagacagaacaggcaggcagttggac

SEQ ID NO: 337 - DNA, 26 bp, Homo sapiens
tagacagaacaggcaggcagttggac

SEQ ID NO: 338 - DNA, 60 bp, Homo sapiens
tttattgattttttactatttttttttttcgacaataaatgcaaaaagtttgaaaaaatc

SEQ ID NO: 339 - DNA, 60 bp, Homo sapiens; identical to SEQ ID NO: 338

SEQ ID NO: 340 - DNA, 60 bp, Homo sapiens
tttttaaagaaggtttgtatcatatttctcgatattattctatcagtcctgcagtcctgt

SEQ ID NO: 341 - DNA, 60 bp, Homo sapiens; identical to SEQ ID NO: 340

SEQ ID NO: 342 - DNA, 60 bp, Homo sapiens
caatattttcagagtcataatatatacatcgaataattttcactttcatcacattctgta

SEQ ID NO: 343 - DNA, 60 bp, Homo sapiens; identical to SEQ ID NO: 342

SEQ ID NO: 344 - DNA, 60 bp, Homo sapiens
tacctttatttttgaagcatatcttcactcgaaatttaatttaattttaattagcttaaa

SEQ ID NO: 345 - DNA, 60 bp, Homo sapiens; identical to SEQ ID NO: 344

SEQ ID NO: 346 - DNA, 60 bp, Homo sapiens
cctttcaatgtattgttactgctactcatcgaggagataaatctcccagtcctagttggt

SEQ ID NO: 347 - DNA, 60 bp, Homo sapiens; identical to SEQ ID NO: 346

SEQ ID NO: 348 - DNA, 60 bp, Homo sapiens
cctttcaatgtattgttactgctactcatcgaaagttgatgccaaattgggaagtaagac

SEQ ID NO: 349 - DNA, 60 bp, Homo sapiens; identical to SEQ ID NO: 348

SEQ ID NO: 350 - DNA, 60 bp, Homo sapiens
aattgtatattagactagattagactattcgaatgttaaatatgattatttgctttttat

SEQ ID NO: 351 - DNA, 60 bp, Homo sapiens; identical to SEQ ID NO: 350

SEQ ID NO: 352 - DNA, 60 bp, Homo sapiens
aaccaattttttaaaatatgcttttaagtcgattggatatgaacactacctgctaagtta

SEQ ID NO: 353 - DNA, 60 bp, Homo sapiens; identical to SEQ ID NO: 352

SEQ ID NO: 354 - DNA, 60 bp, Homo sapiens
tttagtattagaaatgttttggtctttatcgaaagacacgtatgagaaagctaacagtag

SEQ ID NO: 355 - DNA, 60 bp, Homo sapiens; identical to SEQ ID NO: 354

SEQ ID NO: 356 - DNA, 60 bp, Homo sapiens
ggatcaaacccttcatatataccaattatcgaaatatgaatcatctttgtccagtatgga

SEQ ID NO: 357 - DNA, 60 bp, Homo sapiens; identical to SEQ ID NO: 356

SEQ ID NO: 358 - DNA, 60 bp, Homo sapiens
ttttttatatcatacttttggttttaaatcgatttcctctgtaaaattatagaatggact

SEQ ID NO: 359 - DNA, 60 bp, Homo sapiens; identical to SEQ ID NO: 358

SEQ ID NO: 360 - DNA, 60 bp, Homo sapiens
cacaaaataacaaatatataagatattttcgaagattaatatctactcataatggttaga

SEQ ID NO: 361 - DNA, 60 bp, Homo sapiens; identical to SEQ ID NO: 360

SEQ ID NO: 362 - DNA, 60 bp, Homo sapiens
tcatcttctataaaaatcatttaattaatcgatttttattgccagaaacgactcttaaag

SEQ ID NO: 363 - DNA, 60 bp, Homo sapiens; identical to SEQ ID NO: 362

SEQ ID NO: 364 - DNA, 60 bp, Homo sapiens
aataacaattcaccaaaattttaaacattcgaatttttaaatttatttctgtaaataaag

SEQ ID NO: 365 - DNA, 60 bp, Homo sapiens; identical to SEQ ID NO: 364

SEQ ID NO: 366 - DNA, 60 bp, Homo sapiens
aaagattagtttcaaaatttctataaactcgatggatatagcaaaccaattggtttccct

SEQ ID NO: 367 - DNA, 60 bp, Homo sapiens; identical to SEQ ID NO: 366

SEQ ID NO: 368 - DNA, 60 bp, Homo sapiens
ggtatttcttttatgtatgatatattcttcgagtcgctcagaagcgacctaaagaaggca

SEQ ID NO: 369 - DNA, 60 bp, Homo sapiens; identical to SEQ ID NO: 368

SEQ ID NO: 370 - DNA, 60 bp, Homo sapiens
atgcagttcatcaactagtgtgatgaactcgaatgtgatcatgtaagagatcactgtgtg

SEQ ID NO: 371 - DNA, 60 bp, Homo sapiens; identical to SEQ ID NO: 370

SEQ ID NO: 372 - DNA, 60 bp, Homo sapiens
ctatatttgcttcataattttttctttttcgacattgaagtgtataccagtctacttttg

SEQ ID NO: 373 - DNA, 60 bp, Homo sapiens; identical to SEQ ID NO: 372

SEQ ID NO: 374 - DNA, 60 bp, Homo sapiens
atcagtttattttactttattttttatttcgaaaaaatgaaacgatacagcaacattgag

SEQ ID NO: 375 - DNA, 60 bp, Homo sapiens; identical to SEQ ID NO: 374

SEQ ID NO: 376 - DNA, 60 bp, Homo sapiens
ttatatcattattttataatgtattccttcgaaatataagttagttaaaattaaacataa

SEQ ID NO: 377 - DNA, 60 bp, Homo sapiens; identical to SEQ ID NO: 376

SEQ ID NO: 378 - DNA, 60 bp, Homo sapiens
ctcattatactgagtttatttgttttattcgaataactatatccttacattcagtcacta

SEQ ID NO: 379 - DNA, 60 bp, Homo sapiens; identical to SEQ ID NO: 378

SEQ ID NO: 380 - DNA, 60 bp, Homo sapiens
tcataaaataataattaacaaacatacatcgaacatactaatctttttaccaagtgtttg

SEQ ID NO: 381 - DNA, 60 bp, Homo sapiens; identical to SEQ ID NO: 380

SEQ ID NO: 382 - DNA, 60 bp, Homo sapiens
tagctgtttaattatcaatatattaatttcgataattttctctcttccattttctttatt

SEQ ID NO: 383 - DNA, 60 bp, Homo sapiens; identical to SEQ ID NO: 382

SEQ ID NO: 384 - DNA, 60 bp, Homo sapiens
aatatatttctaaaatatgtaaatatattcgatatatgttttatgagtaaagaagcagat

SEQ ID NO: 385 - DNA, 60 bp, Homo sapiens; identical to SEQ ID NO: 384

SEQ ID NO: 386 - DNA, 60 bp, Homo sapiens; identical to SEQ ID NO: 188

SEQ ID NO: 387 - DNA, 60 bp, Homo sapiens; identical to SEQ ID NO: 188

SEQ ID NO: 388 - DNA, 60 bp, Homo sapiens
atttttttttattattatacttttaagttcgaacttctttatctttgtggaaaaccctcc

SEQ ID NO: 389 - DNA, 60 bp, Homo sapiens; identical to SEQ ID NO: 388

SEQ ID NO: 390 - DNA, 60 bp, Homo sapiens
gttctctgactttttatacctaagataatcgatatgaaaatgttctattctattatctca

SEQ ID NO: 391 - DNA, 60 bp, Homo sapiens; identical to SEQ ID NO: 390

SEQ ID NO: 392 - DNA, 60 bp, Homo sapiens
tatatttaattataattgtaacacaatgtcgaaggaaaaattaggaaataattgtaagaa

SEQ ID NO: 393 - DNA, 60 bp, Homo sapiens; identical to SEQ ID NO: 392

SEQ ID NO: 394 - DNA, 60 bp, Homo sapiens
tatatggtacatattatacatatttctatcgaagaagaaggattaaaaaaactgggagta

SEQ ID NO: 395 - DNA, 60 bp, Homo sapiens; identical to SEQ ID NO: 394

SEQ ID NO: 396 - DNA, 60 bp, Homo sapiens
tatatggtacatattatacatatttctatcgagaaataaactcatatatttatgatctac

SEQ ID NO: 397 - DNA, 60 bp, Homo sapiens; identical to SEQ ID NO: 396

SEQ ID NO: 398 - DNA, 60 bp, Homo sapiens; identical to SEQ ID NO: 368

SEQ ID NO: 399 - DNA, 60 bp, Homo sapiens; identical to SEQ ID NO: 368

SEQ ID NO: 400 - DNA, 60 bp, Homo sapiens
gtttctttttaaagtaaattaaatttaatcgaagtatgcactgtaacttctataatctta

SEQ ID NO: 401 - DNA, 60 bp, Homo sapiens; identical to SEQ ID NO: 400

SEQ ID NO: 402 - DNA, 60 bp, Homo sapiens
tatctctatgtaataatcactaaaagtatcgagctacatactattatatattttcacagt

SEQ ID NO: 403 - DNA, 60 bp, Homo sapiens; identical to SEQ ID NO: 402

SEQ ID NO: 404 - DNA, 60 bp, Homo sapiens
ccacggaggggtccttctgaactgcaattcgagagctggtcttgacgaggtgtgccttgc

SEQ ID NO: 405 - DNA, 60 bp, Homo sapiens; identical to SEQ ID NO: 404

SEQ ID NO: 406 - DNA, 60 bp, Homo sapiens
tatgaaaatataaaagaatataaagagttcgattatgtgtcttgaaaacaagaattgaga

SEQ ID NO: 407 - DNA, 60 bp, Homo sapiens; identical to SEQ ID NO: 406

SEQ ID NO: 408 - DNA, 60 bp, Homo sapiens
ctaataataattatgctgttaagctcaatcgacaataaatacttaaaattcacacggttt

SEQ ID NO: 409 - DNA, 60 bp, Homo sapiens; identical to SEQ ID NO: 408

SEQ ID NO: 410 - DNA, 60 bp, Homo sapiens
tatatattaagttatacaacatgatatttcgaaggaaaaaattgatatacagaatgaagc

SEQ ID NO: 411 - DNA, 60 bp, Homo sapiens; identical to SEQ ID NO: 410

SEQ ID NO: 412 - DNA, 60 bp, Homo sapiens
gttattatactgctaaataataagatcctcgagcttcactttttatatatgtaaaatgga

SEQ ID NO: 413 - DNA, 60 bp, Homo sapiens; identical to SEQ ID NO: 412

SEQ ID NO: 414 - DNA, 60 bp, Homo sapiens
atttttaattattaaaaaataatgtttttcgacttgtattacctcatgtagttctcatat

SEQ ID NO: 415 - DNA, 60 bp, Homo sapiens; identical to SEQ ID NO: 414

SEQ ID NO: 416 - DNA, 60 bp, Homo sapiens
tttaggaaaataaatctgaccaaaaaattcgaggccgcagtaagctgtgttcacaccact

SEQ ID NO: 417 - DNA, 60 bp, Homo sapiens; identical to SEQ ID NO: 416

SEQ ID NO: 418 - DNA, 60 bp, Homo sapiens
tttaatcagtttcctttttttttttttttcgaaaaaaaaaaaaagccattgaagggattt

SEQ ID NO: 419 - DNA, 60 bp, Homo sapiens; identical to SEQ ID NO: 418

SEQ ID NO: 420 - DNA, 60 bp, Homo sapiens
ttactcacttattagtctattaagattttcgattaagtctaatttagcactttctctttt

SEQ ID NO: 421 - DNA, 60 bp, Homo sapiens; identical to SEQ ID NO: 420

SEQ ID NO: 422 - DNA, 60 bp, Homo sapiens
aaataacttacatatggacatgagtatatcgatattgttccttcccatgtttgtaaaagg

SEQ ID NO: 423 - DNA, 60 bp, Homo sapiens; identical to SEQ ID NO: 422

SEQ ID NO: 424 - DNA, 60 bp, Homo sapiens
tctgatatatatttgctaaggtagtaaatcgaaatacaaattttggaattgaagggaatt

SEQ ID NO: 425 - DNA, 60 bp, Homo sapiens; identical to SEQ ID NO: 424

SEQ ID NO: 426 - DNA, 60 bp, Homo sapiens
gtaaatattaccattaaaaactgaaaagtcgattatctctttatgacgtttattagacaa

SEQ ID NO: 427 - DNA, 60 bp, Homo sapiens; identical to SEQ ID NO: 426

SEQ ID NO: 428 - DNA, 60 bp, Homo sapiens
actcttcaaaattataattatcaacaattcgaagaataccttaaaggtaatcatatgtat

SEQ ID NO: 429 - DNA, 60 bp, Homo sapiens; identical to SEQ ID NO: 428

SEQ ID NO: 430 - DNA, 60 bp, Homo sapiens
aaggcaggtggatcataaggtcaggagatcgaaaaaaaaataaaaaaataaaaaaataaa

SEQ ID NO: 431 - DNA, 60 bp, Homo sapiens; identical to SEQ ID NO: 430

SEQ ID NO: 432 - DNA, 60 bp, Homo sapiens
tttaaaatgctttaaaattgtttaaatatcgattctagaggaagtcaaataaaacaatgg

SEQ ID NO: 433 - DNA, 60 bp, Homo sapiens; identical to SEQ ID NO: 432

SEQ ID NO: 434 - DNA, 60 bp, Homo sapiens
tatctctatgtaataatcactaaaagtatcgagtacatagctctgacatatttatatgta

SEQ ID NO: 435 - DNA, 60 bp, Homo sapiens; identical to SEQ ID NO: 434

SEQ ID NO: 436 - DNA, 60 bp, Homo sapiens
aatacactacagctatatgtccctgtcttcgaagacagggacatatagctgtagtgtatt

SEQ ID NO: 437 - DNA, 60 bp, Homo sapiens; identical to SEQ ID NO: 436

SEQ ID NO: 438 - DNA, 26 bp, Homo sapiens
ctcaagttgtcacagcattaccacct

SEQ ID NO: 439 - DNA, 26 bp, Homo sapiens
ctcaagttgtcacagcattaccacct

SEQ ID NO: 440 - DNA, 26 bp, Homo sapiens
cagtcttggctggtgatgattcctga

SEQ ID NO: 441 - DNA, 26 bp, Homo sapiens
cagtcttggctggtgatgattcctga

SEQ ID NO: 442 - DNA, 23 bp, Homo sapiens
cctcctgaaccaccacctctggc

SEQ ID NO: 443 - DNA, 23 bp, Homo sapiens
cctcctgaaccaccacctctggc

SEQ ID NO: 444 - DNA, 25 bp, Homo sapiens
caagtaatcatttctcttcattttg

SEQ ID NO: 445 - DNA, 25 bp, Homo sapiens
caagtaatcatttctcttcattttg

SEQ ID NO: 446 - DNA, 26 bp, Homo sapiens
aagcccttgttgagacctacttcctc

SEQ ID NO: 447 - DNA, 26 bp, Homo sapiens
aagcccttgttgagacctacttcctc

SEQ ID NO: 448 - DNA, 26 bp, Homo sapiens
aagcccttgttgagacctacttcctc

SEQ ID NO: 449 - DNA, 26 bp, Homo sapiens
aagcccttgttgagacctacttcctc

SEQ ID NO: 450 - DNA, 26 bp, Homo sapiens
taaacttgctggtctcttccacagta

SEQ ID NO: 451 - DNA, 26 bp, Homo sapiens
taaacttgctggtctcttccacagta

SEQ ID NO: 452 - DNA, 25 bp, Homo sapiens
ggcagcctactttgcttgctctcaa

SEQ ID NO: 453 - DNA, 25 bp, Homo sapiens
ggcagcctactttgcttgctctcaa

SEQ ID NO: 454 - DNA, 23 bp, Homo sapiens
ccactacaaccaccatcactcgc

SEQ ID NO: 455 - DNA, 23 bp, Homo sapiens
ccactacaaccaccatcactcgc

SEQ ID NO: 456 - DNA, 23 bp, Homo sapiens
ggtagtctctgaggtgtcattct

SEQ ID NO: 457 - DNA, 23 bp, Homo sapiens
ggtagtctctgaggtgtcattct

SEQ ID NO: 458 - DNA, 23 bp, Homo sapiens
gccaacacatcaggagtgggaag

SEQ ID NO: 459 - DNA, 23 bp, Homo sapiens
gccaacacatcaggagtgggaag

SEQ ID NO: 460 - DNA, 26 bp, Homo sapiens
gtgttgggcattgagaaagtggtgaa

SEQ ID NO: 461 - DNA, 26 bp, Homo sapiens
gtgttgggcattgagaaagtggtgaa

SEQ ID NO: 462 - DNA, 26 bp, Homo sapiens
ctcctgacctcaaatgatactcttgt

SEQ ID NO: 463 - DNA, 26 bp, Homo sapiens
ctcctgacctcaaatgatactcttgt

SEQ ID NO: 464 - DNA, 25 bp, Homo sapiens
taaccagggtagccttgatgccagc

SEQ ID NO: 465 - DNA, 25 bp, Homo sapiens
taaccagggtagccttgatgccagc

SEQ ID NO: 466 - DNA, 26 bp, Homo sapiens
gccaagaagtagtagttattccctcc

SEQ ID NO: 467 - DNA, 26 bp, Homo sapiens
gccaagaagtagtagttattccctcc

SEQ ID NO: 468 - DNA, 24 bp, Homo sapiens
aagacattgtttagcaacttccaa

SEQ ID NO: 469 - DNA, 24 bp, Homo sapiens
aagacattgtttagcaacttccaa

SEQ ID NO: 470 - DNA, 26 bp, Homo sapiens
cagcagcacatcacaggaaacagttc

SEQ ID NO: 471 - DNA, 26 bp, Homo sapiens
cagcagcacatcacaggaaacagttc

SEQ ID NO: 472 - DNA, 26 bp, Homo sapiens
gaataagcacttcttcttggattagc

SEQ ID NO: 473 - DNA, 26 bp, Homo sapiens
gaataagcacttcttcttggattagc

SEQ ID NO: 474 - DNA, 23 bp, Homo sapiens
gcaggaaaaccaggaaggcagag

SEQ ID NO: 475 - DNA, 23 bp, Homo sapiens
gcaggaaaaccaggaaggcagag

SEQ ID NO: 476 - DNA, 26 bp, Homo sapiens
acctactgtgctgccagacatagaaa

SEQ ID NO: 477 - DNA, 26 bp, Homo sapiens
acctactgtgctgccagacatagaaa

SEQ ID NO: 478 - DNA, 26 bp, Homo sapiens
ccagttatttgctccagtgttcctcc

SEQ ID NO: 479 - DNA, 26 bp, Homo sapiens
ccagttatttgctccagtgttcctcc

SEQ ID NO: 480 - DNA, 26 bp, Homo sapiens
cccgcccacatcctgagaatcctttt

SEQ ID NO: 481 - DNA, 26 bp, Homo sapiens
cccgcccacatcctgagaatcctttt

SEQ ID NO: 482 - DNA, 26 bp, Homo sapiens
ctcttctgaccctttgcccttcccat

SEQ ID NO: 483 - DNA, 26 bp, Homo sapiens
ctcttctgaccctttgcccttcccat

SEQ ID NO: 484 - DNA, 26 bp, Homo sapiens
gggatgcctgggacataagtcagatg

SEQ ID NO: 485 - DNA, 26 bp, Homo sapiens
gggatgcctgggacataagtcagatg

SEQ ID NO: 486 - DNA, 23 bp, Homo sapiens
gaagcgagttgctgtcactggag

SEQ ID NO: 487 - DNA, 23 bp, Homo sapiens
gaagcgagttgctgtcactggag

SEQ ID NO: 488 - DNA, 23 bp, Homo sapiens
gtttcaggaccaccctctacacc

SEQ ID NO: 489 - DNA, 23 bp, Homo sapiens
gtttcaggaccaccctctacacc

SEQ ID NO: 490 - DNA, 26 bp, Homo sapiens
agcccttggcacatagtattcactca

SEQ ID NO: 491 - DNA, 26 bp, Homo sapiens
agcccttggcacatagtattcactca

SEQ ID NO: 492 - DNA, 23 bp, Homo sapiens
caacctaacacaacatagcctgc

SEQ ID NO: 493 - DNA, 23 bp, Homo sapiens
caacctaacacaacatagcctgc

SEQ ID NO: 494 - DNA, 24 bp, Homo sapiens
catttgtcaactcacactctaaaa

SEQ ID NO: 495 - DNA, 24 bp, Homo sapiens
catttgtcaactcacactctaaaa

SEQ ID NO: 496 - DNA, 24 bp, Homo sapiens
acatttgtcaactcacactctaaa

SEQ ID NO: 497 - DNA, 24 bp, Homo sapiens
acatttgtcaactcacactctaaa

SEQ ID NO: 498 - DNA, 24 bp, Homo sapiens
aagacattgtttagcaacttccaa

SEQ ID NO: 499 - DNA, 24 bp, Homo sapiens
aagacattgtttagcaacttccaa

SEQ ID NO: 500 - DNA, 25 bp, Homo sapiens
tattattttcattggctttcaccag

SEQ ID NO: 501 - DNA, 25 bp, Homo sapiens
tattattttcattggctttcaccag

SEQ ID NO: 502 - DNA, 25 bp, Homo sapiens
ccttgatagagaaaacaaaatgctt

SEQ ID NO: 503 - DNA, 25 bp, Homo sapiens
ccttgatagagaaaacaaaatgctt

SEQ ID NO: 504 - DNA, 23 bp, Homo sapiens
cagaagttcacaggcagggtgtc

SEQ ID NO: 505 - DNA, 23 bp, Homo sapiens
cagaagttcacaggcagggtgtc

SEQ ID NO: 506 - DNA, 23 bp, Homo sapiens
ccccagagttcctttggctccca

SEQ ID NO: 507 - DNA, 23 bp, Homo sapiens
ccccagagttcctttggctccca

SEQ ID NO: 508 - DNA, 26 bp, Homo sapiens
caatgggatacttctcttgggtttgg

SEQ ID NO: 509 - DNA, 26 bp, Homo sapiens
caatgggatacttctcttgggtttgg

SEQ ID NO: 510 - DNA, 26 bp, Homo sapiens
ggtgatgggactaagcctcaggtttt

SEQ ID NO: 511 - DNA, 26 bp, Homo sapiens
ggtgatgggactaagcctcaggtttt

SEQ ID NO: 512 - DNA, 26 bp, Homo sapiens
ccagagagccagtgctttcaactcca

SEQ ID NO: 513 - DNA, 26 bp, Homo sapiens
ccagagagccagtgctttcaactcca

SEQ ID NO: 514 - DNA, 26 bp, Homo sapiens
caggctattggaatggctgaagtgtg

SEQ ID NO: 515 - DNA, 26 bp, Homo sapiens
caggctattggaatggctgaagtgtg

SEQ ID NO: 516 - DNA, 26 bp, Homo sapiens
cctacacacacacaacagcaaaataa

SEQ ID NO: 517 - DNA, 26 bp, Homo sapiens
cctacacacacacaacagcaaaataa

SEQ ID NO: 518 - DNA, 26 bp, Homo sapiens
agggaagaaggctgctatgtattggg

SEQ ID NO: 519 - DNA, 26 bp, Homo sapiens
agggaagaaggctgctatgtattggg

SEQ ID NO: 520 - DNA, 25 bp, Homo sapiens
tttagcagtgaagtcatcaggtcct

SEQ ID NO: 521 - DNA, 25 bp, Homo sapiens
tttagcagtgaagtcatcaggtcct

SEQ ID NO: 522 - DNA, 26 bp, Homo sapiens
tcaaaatgataggttcacagttcgtg

SEQ ID NO: 523 - DNA, 26 bp, Homo sapiens
tcaaaatgataggttcacagttcgtg

SEQ ID NO: 524 - DNA, 26 bp, Homo sapiens
cacattcttttgggctctgccactcc

SEQ ID NO: 525 - DNA, 26 bp, Homo sapiens
cacattcttttgggctctgccactcc

SEQ ID NO: 526 - DNA, 26 bp, Homo sapiens
ggactccaaagtgactaaaatcaatg

SEQ ID NO: 527 - DNA, 26 bp, Homo sapiens
ggactccaaagtgactaaaatcaatg

SEQ ID NO: 528 - DNA, 23 bp, Homo sapiens
agaaccctggtcccaccccttta

SEQ ID NO: 529 - DNA, 23 bp, Homo sapiens
agaaccctggtcccaccccttta

SEQ ID NO: 530 - DNA, 23 bp, Homo sapiens
gtaataccagcactttaggaggc

SEQ ID NO: 531 - DNA, 23 bp, Homo sapiens
gtaataccagcactttaggaggc

SEQ ID NO: 532 - DNA, 26 bp, Homo sapiens
agtgagataatgtgcctgaaagcaat

SEQ ID NO: 533 - DNA, 26 bp, Homo sapiens
agtgagataatgtgcctgaaagcaat

SEQ ID NO: 534 - DNA, 25 bp, Homo sapiens
accttgatagagaaaacaaaatgct

SEQ ID NO: 535 - DNA, 25 bp, Homo sapiens
accttgatagagaaaacaaaatgct

SEQ ID NO: 536 - DNA, 23 bp, Homo sapiens
cgcaacgggtcccagcatcatct

SEQ ID NO: 537 - DNA, 23 bp, Homo sapiens
cgcaacgggtcccagcatcatct

SEQ ID NO: 538 - DNA, 26 bp, Homo sapiens
cttgacctcttgacgccttctacttc

SEQ ID NO: 539 - DNA, 26 bp, Homo sapiens
cttgacctcttgacgccttctacttc

SEQ ID NO: 540 - DNA, 26 bp, Homo sapiens
cccttcagtggaaccttacccaacaa

SEQ ID NO: 541 - DNA, 26 bp, Homo sapiens
cccttcagtggaaccttacccaacaa

SEQ ID NO: 542 - DNA, 25 bp, Homo sapiens
ggagttctttccttgggtgttacag

SEQ ID NO: 543 - DNA, 25 bp, Homo sapiens
ggagttctttccttgggtgttacag

SEQ ID NO: 544 - DNA, 24 bp, Homo sapiens
gattcctaagaaacctaccattat

SEQ ID NO: 545 - DNA, 24 bp, Homo sapiens
gattcctaagaaacctaccattat

SEQ ID NO: 546 - DNA, 26 bp, Homo sapiens
tgtggaaaggtgattggctcaacagc

SEQ ID NO: 547 - DNA, 26 bp, Homo sapiens
tgtggaaaggtgattggctcaacagc

SEQ ID NO: 548 - DNA, 26 bp, Homo sapiens
gagcaagagcagtttggctgtgttgt

SEQ ID NO: 549 - DNA, 26 bp, Homo sapiens
gagcaagagcagtttggctgtgttgt

SEQ ID NO: 550 - DNA, 26 bp, Homo sapiens
cattgctctaccccaccttctgagga

SEQ ID NO: 551 - DNA, 26 bp, Homo sapiens
cattgctctaccccaccttctgagga

SEQ ID NO: 552 - DNA, 26 bp, Homo sapiens
ctctccttctgtgtatgggtaagacc

SEQ ID NO: 553 - DNA, 26 bp, Homo sapiens
ctctccttctgtgtatgggtaagacc

SEQ ID NO: 554 - DNA, 23 bp, Homo sapiens
gtttgggcggtttccaggatggg

SEQ ID NO: 555 - DNA, 23 bp, Homo sapiens
gtttgggcggtttccaggatggg

SEQ ID NO: 556 - DNA, 23 bp, Homo sapiens
ctactaagtggctaatgggtggg

SEQ ID NO: 557 - DNA, 23 bp, Homo sapiens
ctactaagtggctaatgggtggg

SEQ ID NO: 558 - DNA, 25 bp, Homo sapiens
gcttccctcctctgtagccaatagc

SEQ ID NO: 559 - DNA, 25 bp, Homo sapiens
gcttccctcctctgtagccaatagc

SEQ ID NO: 560 - DNA, 26 bp, Homo sapiens
gccaaagactcctctgggaatccaac

SEQ ID NO: 561 - DNA, 26 bp, Homo sapiens
gccaaagactcctctgggaatccaac

SEQ ID NO: 562 - DNA, 26 bp, Homo sapiens
tcttggcataaagcagggctccagga

SEQ ID NO: 563 - DNA, 26 bp, Homo sapiens
tcttggcataaagcagggctccagga

SEQ ID NO: 564 - DNA, 26 bp, Homo sapiens
ttgtcagtgttacaggattagactcc

SEQ ID NO: 565 - DNA, 26 bp, Homo sapiens
ttgtcagtgttacaggattagactcc

SEQ ID NO: 566 - DNA, 26 bp, Homo sapiens
cctcaacatcccaaaacgggttcctc

SEQ ID NO: 567 - DNA, 26 bp, Homo sapiens
cctcaacatcccaaaacgggttcctc

SEQ ID NO: 568 - DNA, 24 bp, Homo sapiens
tttgtaaacggttgggagacttag

SEQ ID NO: 569 - DNA, 24 bp, Homo sapiens
tttgtaaacggttgggagacttag

SEQ ID NO: 570 - DNA, 26 bp, Homo sapiens
aactgggttctgggacttttcctcag

SEQ ID NO: 571 - DNA, 26 bp, Homo sapiens
aactgggttctgggacttttcctcag

SEQ ID NO: 572 - DNA, 23 bp, Homo sapiens
gggatgttgcctccgagacaaaa

SEQ ID NO: 573 - DNA, 23 bp, Homo sapiens
gggatgttgcctccgagacaaaa

SEQ ID NO: 574 - DNA, 23 bp, Homo sapiens
gggagccagagaacacctgcttc

SEQ ID NO: 575 - DNA, 23 bp, Homo sapiens
gggagccagagaacacctgcttc

SEQ ID NO: 576 - DNA, 26 bp, Homo sapiens
gagggactgggtgggaggagtatttt

SEQ ID NO: 577 - DNA, 26 bp, Homo sapiens
gagggactgggtgggaggagtatttt

SEQ ID NO: 578 - DNA, 26 bp, Homo sapiens
ctccaactgaccactaaaaccacata

SEQ ID NO: 579 - DNA, 26 bp, Homo sapiens
ctccaactgaccactaaaaccacata

SEQ ID NO: 580 - DNA, 26 bp, Homo sapiens
agttccacttccccatactcacaaac

SEQ ID NO: 581 - DNA, 26 bp, Homo sapiens
agttccacttccccatactcacaaac

SEQ ID NO: 582 - DNA, 26 bp, Homo sapiens
gggctaaagtgggtaaagtctcaaaa

SEQ ID NO: 583 - DNA, 26 bp, Homo sapiens
gggctaaagtgggtaaagtctcaaaa

SEQ ID NO: 584 - DNA, 26 bp, Homo sapiens
gacactcacacacagaaatactgcca

SEQ ID NO: 585 - DNA, 26 bp, Homo sapiens
gacactcacacacagaaatactgcca

SEQ ID NO: 586 - DNA, 24 bp, Homo sapiens
ccccaacacaaactgtcctcaggc

SEQ ID NO: 587 - DNA, 24 bp, Homo sapiens
ccccaacacaaactgtcctcaggc

SEQ ID NO: 588 - DNA, 24 bp, Homo sapiens
gaccataccttgccagacctccac

SEQ ID NO: 589 - DNA, 24 bp, Homo sapiens
gaccataccttgccagacctccac

SEQ ID NO: 590 - DNA, 26 bp, Homo sapiens
tatgttgttgcccttgatacggtagc

SEQ ID NO: 591 - DNA, 26 bp, Homo sapiens
tatgttgttgcccttgatacggtagc

SEQ ID NO: 592 - DNA, 23 bp, Homo sapiens
ggattacaggcgtgagccaccac

SEQ ID NO: 593 - DNA, 23 bp, Homo sapiens
ggattacaggcgtgagccaccac

SEQ ID NO: 594 - DNA, 24 bp, Homo sapiens
atgaggcacttgattttgaacttc

SEQ ID NO: 595 - DNA, 24 bp, Homo sapiens
atgaggcacttgattttgaacttc

SEQ ID NO: 596 - DNA, 25 bp, Homo sapiens
tatccagtctcccaacatcatttgt

SEQ ID NO: 597 - DNA, 25 bp, Homo sapiens
tatccagtctcccaacatcatttgt

SEQ ID NO: 598 - DNA, 24 bp, Homo sapiens
tttgtaaacggttgggagacttag

SEQ ID NO: 599 - DNA, 24 bp, Homo sapiens
tttgtaaacggttgggagacttag

SEQ ID NO: 600 - DNA, 25 bp, Homo sapiens
tatttccctaacataacgatagtgc

SEQ ID NO: 601 - DNA, 25 bp, Homo sapiens
tatttccctaacataacgatagtgc

SEQ ID NO: 602 - DNA, 24 bp, Homo sapiens
gtagaagagaaacccagataaata

SEQ ID NO: 603 - DNA, 24 bp, Homo sapiens
gtagaagagaaacccagataaata

SEQ ID NO: 604 - DNA, 23 bp, Homo sapiens
gaccacaggcaccaccataccct

SEQ ID NO: 605 - DNA, 23 bp, Homo sapiens
gaccacaggcaccaccataccct

SEQ ID NO: 606 - DNA, 23 bp, Homo sapiens
cccgaactcccttcctgttttgg

SEQ ID NO: 607 - DNA, 23 bp, Homo sapiens
cccgaactcccttcctgttttgg

SEQ ID NO: 608 - DNA, 26 bp, Homo sapiens
acaggaaagcctactggacaacattg

SEQ ID NO: 609 - DNA, 26 bp, Homo sapiens
acaggaaagcctactggacaacattg

SEQ ID NO: 610 - DNA, 26 bp, Homo sapiens
agtgtgcttggttgaactgaatcatt

SEQ ID NO: 611 - DNA, 26 bp, Homo sapiens
agtgtgcttggttgaactgaatcatt

SEQ ID NO: 612 - DNA, 26 bp, Homo sapiens
ggcaactaacacttgtctcaccttca

SEQ ID NO: 613 - DNA, 26 bp, Homo sapiens
ggcaactaacacttgtctcaccttca

SEQ ID NO: 614 - DNA, 26 bp, Homo sapiens
cctgctctgccactaaccaagtatgt

SEQ ID NO: 615 - DNA, 26 bp, Homo sapiens
cctgctctgccactaaccaagtatgt

SEQ ID NO: 616 - DNA, 23 bp, Homo sapiens
ggactacaggcgtgagccaccac

SEQ ID NO: 617 - DNA, 23 bp, Homo sapiens
ggactacaggcgtgagccaccac

SEQ ID NO: 618 - DNA, 26 bp, Homo sapiens
atccatccttctcacagcagccaaga

SEQ ID NO: 619 - DNA, 26 bp, Homo sapiens
atccatccttctcacagcagccaaga

SEQ ID NO: 620 - DNA, 24 bp, Homo sapiens
attgaatagccatcagcaagaaaa

SEQ ID NO: 621 - DNA, 24 bp, Homo sapiens
attgaatagccatcagcaagaaaa

SEQ ID NO: 622 - DNA, 26 bp, Homo sapiens
tgagacttccatagcagattaccttt

SEQ ID NO: 623 - DNA, 26 bp, Homo sapiens
tgagacttccatagcagattaccttt

SEQ ID NO: 624 - DNA, 26 bp, Homo sapiens
gaacctcatctgtctaaccacaaacc

SEQ ID NO: 625 - DNA, 26 bp, Homo sapiens
gaacctcatctgtctaaccacaaacc

SEQ ID NO: 626 - DNA, 26 bp, Homo sapiens
tagttcaagttcttctcaaaagcccc

SEQ ID NO: 627 - DNA, 26 bp, Homo sapiens
tagttcaagttcttctcaaaagcccc

SEQ ID NO: 628 - DNA, 23 bp, Homo sapiens
gagtcgctgtcccaatggcagga

SEQ ID NO: 629 - DNA, 23 bp, Homo sapiens
gagtcgctgtcccaatggcagga

SEQ ID NO: 630 - DNA, 26 bp, Homo sapiens
ccattttacaggtgaacaaactgatg

SEQ ID NO: 631 - DNA, 26 bp, Homo sapiens
ccattttacaggtgaacaaactgatg

SEQ ID NO: 632 - DNA, 26 bp, Homo sapiens
tagcccctttcccacaacttttctgc

SEQ ID NO: 633 - DNA, 26 bp, Homo sapiens
tagcccctttcccacaacttttctgc

SEQ ID NO: 634 - DNA, 24 bp, Homo sapiens
gttcaaggtttccctctgcttcta

SEQ ID NO: 635 - DNA, 24 bp, Homo sapiens
gttcaaggtttccctctgcttcta

SEQ ID NO: 636 - DNA, 23 bp, Homo sapiens
cttgccttaccacctgctcttcc

SEQ ID NO: 637 - DNA, 23 bp, Homo sapiens
cttgccttaccacctgctcttcc

SEQ ID NO: 638 - DNA, 60 bp, Homo sapiens
tttgtgtttcatgacctgctaaatactttcgaaagtatttagcaggtcatgaaacacaaa

SEQ ID NO: 639 - DNA, 60 bp, Homo sapiens; identical to SEQ ID NO: 638

SEQ ID NO: 640 - DNA, 60 bp, Homo sapiens
ttatatcattattttataatgtattccttcgaaataagcacttaggaagtttgagtaaat

SEQ ID NO: 641 - DNA, 60 bp, Homo sapiens; identical to SEQ ID NO: 640

SEQ ID NO: 642 - DNA, 60 bp, Homo sapiens
tctgtcatcttcttacgtattaacattatcgaatatttgtgatttgaaatttgtcctggt

SEQ ID NO: 643 - DNA, 60 bp, Homo sapiens; identical to SEQ ID NO: 642

SEQ ID NO: 644 - DNA, 60 bp, Homo sapiens
tttcttgtatttcattatgtacatctattcgataaaactttttttctatagttctctgac

SEQ ID NO: 645 - DNA, 60 bp, Homo sapiens; identical to SEQ ID NO: 644

SEQ ID NO: 646 - DNA, 60 bp, Homo sapiens
gtttcatttcatattttcacaaaagatctcgaattatgtgcagtactacaatagtaatgg

SEQ ID NO: 647 - DNA, 60 bp, Homo sapiens; identical to SEQ ID NO: 646

SEQ ID NO: 648 - DNA, 60 bp, Homo sapiens
aacatatataagctttttacttaaaagttcgataatactgtattgtagtcagaatgtttg

SEQ ID NO: 649 - DNA, 60 bp, Homo sapiens; identical to SEQ ID NO: 648

SEQ ID NO: 650 - DNA, 60 bp, Homo sapiens
cacttaacaatataatgtataaatctcctcgaagaaaatgctgaagaatatcttaatgac

SEQ ID NO: 651 - DNA, 60 bp, Homo sapiens; identical to SEQ ID NO: 650

SEQ ID NO: 652 - DNA, 60 bp, Homo sapiens; identical to SEQ ID NO: 188

SEQ ID NO: 653 - DNA, 60 bp, Homo sapiens; identical to SEQ ID NO: 188

SEQ ID NO: 654 - DNA, 60 bp, Homo sapiens
caaagtactactttaatttatgacataatcgaacacagaagtatttatctgaaaagtgga

SEQ ID NO: 655 - DNA, 60 bp, Homo sapiens; identical to SEQ ID NO: 654

SEQ ID NO: 656 - DNA, 60 bp, Homo sapiens
tttaaaattgttgacagaaaatatattatcgacatatatttacctacatagaagagtatg

SEQ ID NO: 657 - DNA, 60 bp, Homo sapiens; identical to SEQ ID NO: 656

SEQ ID NO: 658 - DNA, 60 bp, Homo sapiens
atatgattatggttataactaaactatatcgaacttacttcattaaccttaaaaaataca

SEQ ID NO: 659 - DNA, 60 bp, Homo sapiens; identical to SEQ ID NO: 658

SEQ ID NO: 660 - DNA, 60 bp, Homo sapiens
tatctagatgtaggtatatatttatctatcgactttcaagcaaagaaaatgcaaatatgc

SEQ ID NO: 661 - DNA, 60 bp, Homo sapiens; identical to SEQ ID NO: 660

SEQ ID NO: 662 - DNA, 60 bp, Homo sapiens
ctggaagccttacagatgacataaacaatcgaataaataatggagctaaatggcatatat

SEQ ID NO: 663 - DNA, 60 bp, Homo sapiens; identical to SEQ ID NO: 662

SEQ ID NO: 664 - DNA, 60 bp, Homo sapiens
ctaatttcatttctttttagtttcctcttcgataccttgaattataatacttgttctgat

SEQ ID NO: 665 - DNA, 60 bp, Homo sapiens; identical to SEQ ID NO: 664

SEQ ID NO: 666 - DNA, 60 bp, Homo sapiens
ccacggaggggtccttctgaactgcaattcgaggttcagcaccgtaggtgtagcgcaggc

SEQ ID NO: 667 - DNA, 60 bp, Homo sapiens; identical to SEQ ID NO: 666

SEQ ID NO: 668 - DNA, 60 bp, Homo sapiens
ttcaattgtactgttaatattttatttctcgaataaataatcctcttcttttcctctttc

SEQ ID NO: 669 - DNA, 60 bp, Homo sapiens; identical to SEQ ID NO: 668

SEQ ID NO: 670 - DNA, 60 bp, Homo sapiens
atatgtagatatatgttttcaagcaatatcgaagagtagtaccttatcaaagctttgcag

SEQ ID NO: 671 - DNA, 60 bp, Homo sapiens; identical to SEQ ID NO: 670

SEQ ID NO: 672 - DNA, 60 bp, Homo sapiens
aatagtataattaaaatagtaaagaaaatcgatataccataggtgtatagtaggttatgc

SEQ ID NO: 673 - DNA, 60 bp, Homo sapiens; identical to SEQ ID NO: 672

SEQ ID NO: 674 - DNA, 60 bp, Homo sapiens
gtacatttaatgaaactactaaaatatttcgaatagaaatacaatgccagacacataagt

SEQ ID NO: 675 - DNA, 60 bp, Homo sapiens; identical to SEQ ID NO: 674

SEQ ID NO: 676 - DNA, 60 bp, Homo sapiens
gatgatcaacattcattgagaatgaaaatcgatttataacaaaaataaacactgtagaaa

SEQ ID NO: 677 - DNA, 60 bp, Homo sapiens; identical to SEQ ID NO: 676

SEQ ID NO: 678 - DNA, 60 bp, Homo sapiens
ttactcacttattagtctattaagattttcgatataaaacttataaatggtttatttctg

SEQ ID NO: 679 - DNA, 60 bp, Homo sapiens; identical to SEQ ID NO: 678

SEQ ID NO: 680 - DNA, 60 bp, Homo sapiens
acatatatatatatatatttaatatacatcgatagataattgtcttccagaatattttaa

SEQ ID NO: 681 - DNA, 60 bp, Homo sapiens; identical to SEQ ID NO: 680

SEQ ID NO: 682 - DNA, 60 bp, Homo sapiens
aattagtatttattttttctattttatttcgaatgaatgtaacaggaaagcagaaaagca

SEQ ID NO: 683 - DNA, 60 bp, Homo sapiens; identical to SEQ ID NO: 682

SEQ ID NO: 684 - DNA, 60 bp, Homo sapiens
ttattataaataagtgtatatgtgaaattcgatgtgtttctatttttaaaacctcttaac

SEQ ID NO: 685 - DNA, 60 bp, Homo sapiens; identical to SEQ ID NO: 684

SEQ ID NO: 686 - DNA, 60 bp, Homo sapiens
cctttcaaatttagatttaaaatctatttcgatgctactaaaagcagcaataatactttc

SEQ ID NO: 687 - DNA, 60 bp, Homo sapiens; identical to SEQ ID NO: 686

SEQ ID NO: 688 - DNA, 60 bp, Homo sapiens
tttaaactatttttaaaagagtactttttcgacttggtacaaaatcaaagtaagaagtat

SEQ ID NO: 689 - DNA, 60 bp, Homo sapiens; identical to SEQ ID NO: 688

SEQ ID NO: 690 - DNA, 60 bp, Homo sapiens
ctatattgtagctctattttctctaaattcgaagaatcatgccttaatggattgaaacaa

SEQ ID NO: 691 - DNA, 60 bp, Homo sapiens; identical to SEQ ID NO: 690

SEQ ID NO: 692 - DNA, 60 bp, Homo sapiens
tttttattttatcttttattttattttttcgaattcatgttttttctcttggaattttct

SEQ ID NO: 693 - DNA, 60 bp, Homo sapiens; identical to SEQ ID NO: 692

SEQ ID NO: 694 - DNA, 60 bp, Homo sapiens
cctaccagaactcttaaatctataatattcgaaattttattatcttaggtgagaaaatag

SEQ ID NO: 695 - DNA, 60 bp, Homo sapiens; identical to SEQ ID NO: 694

SEQ ID NO: 696 - DNA, 60 bp, Homo sapiens
gtaactactacattttagtatatttctttcgatcagaagttaactctaattgaatcatag

SEQ ID NO: 697 - DNA, 60 bp, Homo sapiens; identical to SEQ ID NO: 696

SEQ ID NO: 698 - DNA, 60 bp, Homo sapiens
tatctctatgtaataatcactaaaagtatcgattcatgcttggttgaatcagacaatgtc

SEQ ID NO: 699 - DNA, 60 bp, Homo sapiens; identical to SEQ ID NO: 698

SEQ ID NO: 700 - DNA, 60 bp, Homo sapiens
atctcatttaacaaaagatgagtaaaaatcgattttttaacgaatgtatctgaaaatagc

SEQ ID NO: 701 - DNA, 60 bp, Homo sapiens; identical to SEQ ID NO: 700

SEQ ID NO: 702 - DNA, 60 bp, Homo sapiens
tcgcttttcttatataaaggaacatttctcgagtggtaatgtaccaatcattcattgatt

SEQ ID NO: 703 - DNA, 60 bp, Homo sapiens; identical to SEQ ID NO: 702

SEQ ID NO: 704 - DNA, 60 bp, Homo sapiens
ttctcatgtttctttttctgactaaatgtcgattgagatataattgacataataaattac

SEQ ID NO: 705 - DNA, 60 bp, Homo sapiens; identical to SEQ ID NO: 704

SEQ ID NO: 706 - DNA, 60 bp, Homo sapiens
tctgtgattaatggataaatgtgatatatcgacagcatttactattcatgttacttcatt

SEQ ID NO: 707 - DNA, 60 bp, Homo sapiens; identical to SEQ ID NO: 706

SEQ ID NO: 708 - DNA, 60 bp, Homo sapiens
tttatttaccttcttgtatgaatattgatcgaatctcaacatccttaacatagttacatc

SEQ ID NO: 709 - DNA, 60 bp, Homo sapiens; identical to SEQ ID NO: 708

SEQ ID NO: 710 - DNA, 60 bp, Homo sapiens
atatgctttttttaaattacaaaacttatcgatcattttttaaatttaaaactctgaagc

SEQ ID NO: 711 - DNA, 60 bp, Homo sapiens; identical to SEQ ID NO: 710

SEQ ID NO: 712 - DNA, 26 bp, Homo sapiens
ttatgccccaccttcttcagtgtaat

SEQ ID NO: 713 - DNA, 26 bp, Homo sapiens
ttatgccccaccttcttcagtgtaat

SEQ ID NO: 714 - DNA, 26 bp, Homo sapiens
acctactgtgctgccagacatagaaa

SEQ ID NO: 715 - DNA, 26 bp, Homo sapiens
acctactgtgctgccagacatagaaa

SEQ ID NO: 716 - DNA, 26 bp, Homo sapiens
tcccttgaaaacctgtgtccaatgac

SEQ ID NO: 717 - DNA, 26 bp, Homo sapiens
tcccttgaaaacctgtgtccaatgac

SEQ ID NO: 718 - DNA, 24 bp, Homo sapiens
tcagtgtttgcttttcccttgaat

SEQ ID NO: 719 - DNA, 24 bp, Homo sapiens
tcagtgtttgcttttcccttgaat

SEQ ID NO: 720 - DNA, 24 bp, Homo sapiens
aggttgaagttgaaacacagatgt

SEQ ID NO: 721 - DNA, 24 bp, Homo sapiens
aggttgaagttgaaacacagatgt

SEQ ID NO: 722 - DNA, 19 bp, Homo sapiens
tttttaatagtgcttcaaa

SEQ ID NO: 723 - DNA, 19 bp, Homo sapiens
tttttaatagtgcttcaaa

SEQ ID NO: 724 - DNA, 28 bp, Homo sapiens
ctcttttatttaccactccattcttcca

SEQ ID NO: 725 - DNA, 28 bp, Homo sapiens
ctcttttatttaccactccattcttcca

SEQ ID NO: 726 - DNA, 23 bp, Homo sapiens
gaagcgagttgctgtcactggag

SEQ ID NO: 727 - DNA, 23 bp, Homo sapiens
gaagcgagttgctgtcactggag

SEQ ID NO: 728 - DNA, 26 bp, Homo sapiens
ccactgtcagggaaatagttgaagga

SEQ ID NO: 729 - DNA, 26 bp, Homo sapiens
ccactgtcagggaaatagttgaagga

SEQ ID NO: 730 - DNA, 26 bp, Homo sapiens
cagaaaagcccaggaaggtatcagat

SEQ ID NO: 731 - DNA, 26 bp, Homo sapiens
cagaaaagcccaggaaggtatcagat

SEQ ID NO: 732 - DNA, 20 bp, Homo sapiens
ccactgacttcactgtttaa

SEQ ID NO: 733 - DNA, 20 bp, Homo sapiens
ccactgacttcactgtttaa

SEQ ID NO: 734 - DNA, 26 bp, Homo sapiens
ctgttctcagcaatggaatctcaggt

SEQ ID NO: 735 - DNA, 26 bp, Homo sapiens
ctgttctcagcaatggaatctcaggt

SEQ ID NO: 736 - DNA, 26 bp, Homo sapiens
agggagaggagacagatgttctttct

SEQ ID NO: 737 - DNA, 26 bp, Homo sapiens
agggagaggagacagatgttctttct

SEQ ID NO: 738 - DNA, 26 bp, Homo sapiens
cactgttgtcttattgccttgctcag

SEQ ID NO: 739 - DNA, 26 bp, Homo sapiens
cactgttgtcttattgccttgctcag

SEQ ID NO: 740 - DNA, 23 bp, Homo sapiens
cagaagttcacaggcagggtgtc

SEQ ID NO: 741 - DNA, 23 bp, Homo sapiens
cagaagttcacaggcagggtgtc

SEQ ID NO: 742 - DNA, 26 bp, Homo sapiens
atgcccagtcataggtgataagatta

SEQ ID NO: 743 - DNA, 26 bp, Homo sapiens
atgcccagtcataggtgataagatta

SEQ ID NO: 744 - DNA, 26 bp, Homo sapiens
gttcctcttgctccacttgtcaacag

SEQ ID NO: 745 - DNA, 26 bp, Homo sapiens
gttcctcttgctccacttgtcaacag

SEQ ID NO: 746 - DNA, 26 bp, Homo sapiens
cacatacacagggtaacctaaggaag

SEQ ID NO: 747 - DNA, 26 bp, Homo sapiens
cacatacacagggtaacctaaggaag

SEQ ID NO: 748 - DNA, 24 bp, Homo sapiens
atgataggcacatactctcctctg

SEQ ID NO: 749 - DNA, 24 bp, Homo sapiens
atgataggcacatactctcctctg

SEQ ID NO: 750 - DNA, 26 bp, Homo sapiens
tgtcattttcacaccatcctccccat

SEQ ID NO: 751 - DNA, 26 bp, Homo sapiens
tgtcattttcacaccatcctccccat

SEQ ID NO: 752 - DNA, 26 bp, Homo sapiens
gagtttggaggtgttctctgcccttt

SEQ ID NO: 753 - DNA, 26 bp, Homo sapiens
gagtttggaggtgttctctgcccttt

SEQ ID NO: 754 - DNA, 23 bp, Homo sapiens
gcggagggagagtcacgcaagat

SEQ ID NO: 755 - DNA, 23 bp, Homo sapiens
gcggagggagagtcacgcaagat

SEQ ID NO: 756 - DNA, 23 bp, Homo sapiens
acccaggtggtatgactccagag

SEQ ID NO: 757 - DNA, 23 bp, Homo sapiens
acccaggtggtatgactccagag

SEQ ID NO: 758 - DNA, 26 bp, Homo sapiens
gaggctcaggcaacatcctactttca

SEQ ID NO: 759 - DNA, 26 bp, Homo sapiens
gaggctcaggcaacatcctactttca

SEQ ID NO: 760 - DNA, 25 bp, Homo sapiens
ctttactggtgtcttttatgaacaa

SEQ ID NO: 761 - DNA, 25 bp, Homo sapiens
ctttactggtgtcttttatgaacaa

SEQ ID NO: 762 - DNA, 23 bp, Homo sapiens
gctggtcttgaactcctggcttc

SEQ ID NO: 763 - DNA, 23 bp, Homo sapiens
gctggtcttgaactcctggcttc

SEQ ID NO: 764 - DNA, 25 bp, Homo sapiens
gatttctcagtttacatagttcaaa

SEQ ID NO: 765 - DNA, 25 bp, Homo sapiens
gatttctcagtttacatagttcaaa

SEQ ID NO: 766 - DNA, 26 bp, Homo sapiens
taccagggctgagggtgttgtcctat

SEQ ID NO: 767 - DNA, 26 bp, Homo sapiens
taccagggctgagggtgttgtcctat

SEQ ID NO: 768 - DNA, 24 bp, Homo sapiens
acctaaatagttatgaacagtttc

SEQ ID NO: 769 - DNA, 24 bp, Homo sapiens
acctaaatagttatgaacagtttc

SEQ ID NO: 770 - DNA, 23 bp, Homo sapiens
aagtcaaggcggcagtgagccac

SEQ ID NO: 771 - DNA, 23 bp, Homo sapiens
aagtcaaggcggcagtgagccac

SEQ ID NO: 772 - DNA, 26 bp, Homo sapiens
catttctctgctgccatctcgtggat

SEQ ID NO: 773 - DNA, 26 bp, Homo sapiens
catttctctgctgccatctcgtggat

SEQ ID NO: 774 - DNA, 24 bp, Homo sapiens
acctgaccaaacttgaataaatca

SEQ ID NO: 775 - DNA, 24 bp, Homo sapiens
acctgaccaaacttgaataaatca

SEQ ID NO: 776 - DNA, 26 bp, Homo sapiens
ctggagaggaggagtcttgtttgctt

SEQ ID NO: 777 - DNA, 26 bp, Homo sapiens
ctggagaggaggagtcttgtttgctt

SEQ ID NO: 778 - DNA, 25 bp, Homo sapiens
aactattttcacatcatcttgtaag

SEQ ID NO: 779 - DNA, 25 bp, Homo sapiens
aactattttcacatcatcttgtaag

SEQ ID NO: 780 - DNA, 26 bp, Homo sapiens
ggtgtggaatacaatctgatggtttc

SEQ ID NO: 781 - DNA, 26 bp, Homo sapiens
ggtgtggaatacaatctgatggtttc

SEQ ID NO: 782 - DNA, 26 bp, Homo sapiens
agttctcaacctgtgggatgtattat

SEQ ID NO: 783 - DNA, 26 bp, Homo sapiens
agttctcaacctgtgggatgtattat

SEQ ID NO: 784 - DNA, 26 bp, Homo sapiens
ggctttatgcctgggtcagttctcct

SEQ ID NO: 785 - DNA, 26 bp, Homo sapiens
ggctttatgcctgggtcagttctcct

SEQ ID NO: 786 - DNA, 26 bp, Homo sapiens
ttatgccccaccttcttcagggtaat

SEQ ID NO: 787 - DNA, 26 bp, Homo sapiens
ttatgccccaccttcttcagggtaat

SEQ ID NO: 788 - DNA, 26 bp, Homo sapiens
ccaggataacagcaatgcctacttcc

SEQ ID NO: 789 - DNA, 26 bp, Homo sapiens
ccaggataacagcaatgcctacttcc

SEQ ID NO: 790 - DNA, 26 bp, Homo sapiens
attacctcacccttcctcctgtgctg

SEQ ID NO: 791 - DNA, 26 bp, Homo sapiens
attacctcacccttcctcctgtgctg

SEQ ID NO: 792 - DNA, 24 bp, Homo sapiens
ttgaatggtgaggtgccttgttat

SEQ ID NO: 793 - DNA, 24 bp, Homo sapiens
ttgaatggtgaggtgccttgttat

SEQ ID NO: 794 - DNA, 24 bp, Homo sapiens
aagaaaacgaaggaaggaagattc

SEQ ID NO: 795 - DNA, 24 bp, Homo sapiens
aagaaaacgaaggaaggaagattc

SEQ ID NO: 796 - DNA, 18 bp, Homo sapiens
ttataacaaaatatcatg

SEQ ID NO: 797 - DNA, 18 bp, Homo sapiens
ttataacaaaatatcatg

SEQ ID NO: 798 - DNA, 27 bp, Homo sapiens
aaaactcattgccaaacccaaggtcat

SEQ ID NO: 799 - DNA, 27 bp, Homo sapiens
aaaactcattgccaaacccaaggtcat

SEQ ID NO: 800 - DNA, 24 bp, Homo sapiens
ccccaacacaaactgtcctcaggc

SEQ ID NO: 801 - DNA, 24 bp, Homo sapiens
ccccaacacaaactgtcctcaggc

SEQ ID NO: 802 - DNA, 26 bp, Homo sapiens
atcaatgcctgtgaactatgaaaagc

SEQ ID NO: 803 - DNA, 26 bp, Homo sapiens
atcaatgcctgtgaactatgaaaagc

SEQ ID NO: 804 - DNA, 26 bp, Homo sapiens
ccctccaactgcttgcctatcctttg

SEQ ID NO: 805 - DNA, 26 bp, Homo sapiens
ccctccaactgcttgcctatcctttg

SEQ ID NO: 806 - DNA, 23 bp, Homo sapiens
tcaaatgtccaatactgtctatc

SEQ ID NO: 807 - DNA, 23 bp, Homo sapiens
tcaaatgtccaatactgtctatc

SEQ ID NO: 808 - DNA, 26 bp, Homo sapiens
tcccttctcctgattttccctgtgga

SEQ ID NO: 809 - DNA, 26 bp, Homo sapiens
tcccttctcctgattttccctgtgga

SEQ ID NO: 810 - DNA, 26 bp, Homo sapiens
cttcaagtctgtttgcctattattgc

SEQ ID NO: 811 - DNA, 26 bp, Homo sapiens
cttcaagtctgtttgcctattattgc

SEQ ID NO: 812 - DNA, 26 bp, Homo sapiens
ccctttctcctcctctctgctcctat

SEQ ID NO: 813 - DNA, 26 bp, Homo sapiens
ccctttctcctcctctctgctcctat

SEQ ID NO: 814 - DNA, 23 bp, Homo sapiens
gctccagcaccgtatttcgcctg

SEQ ID NO: 815 - DNA, 23 bp, Homo sapiens
gctccagcaccgtatttcgcctg

SEQ ID NO: 816 - DNA, 24 bp, Homo sapiens
gaagcagaagaaggagcaagaaag

SEQ ID NO: 817 - DNA, 24 bp, Homo sapiens
gaagcagaagaaggagcaagaaag

SEQ ID NO: 818 - DNA, 23 bp, Homo sapiens
gcttcagtaaataccgccaaacg

SEQ ID NO: 819 - DNA, 23 bp, Homo sapiens
gcttcagtaaataccgccaaacg

SEQ ID NO: 820 - DNA, 26 bp, Homo sapiens
ctgaaaagatgctctgctactgggtg

SEQ ID NO: 821 - DNA, 26 bp, Homo sapiens
ctgaaaagatgctctgctactgggtg

SEQ ID NO: 822 - DNA, 26 bp, Homo sapiens
tatcggaacggtaaccaatctcatta

SEQ ID NO: 823 - DNA, 26 bp, Homo sapiens
tatcggaacggtaaccaatctcatta

SEQ ID NO: 824 - DNA, 26 bp, Homo sapiens
tgaaagaggcaccagatgcggaggaa

SEQ ID NO: 825 - DNA, 26 bp, Homo sapiens
tgaaagaggcaccagatgcggaggaa

SEQ ID NO: 826 - DNA, 26 bp, Homo sapiens
ccaacaacaatctccttcctctctat

SEQ ID NO: 827 - DNA, 26 bp, Homo sapiens
ccaacaacaatctccttcctctctat

SEQ ID NO: 828 - DNA, 23 bp, Homo sapiens
gctgggagggtcttacactgagt

SEQ ID NO: 829 - DNA, 23 bp, Homo sapiens
gctgggagggtcttacactgagt

SEQ ID NO: 830 - DNA, 23 bp, Homo sapiens
ggcaagtttcctgctcacccctg

SEQ ID NO: 831 - DNA, 23 bp, Homo sapiens
ggcaagtttcctgctcacccctg

SEQ ID NO: 832 - DNA, 26 bp, Homo sapiens
ctctgaagccaagcatagatagatgg

SEQ ID NO: 833 - DNA, 26 bp, Homo sapiens
ctctgaagccaagcatagatagatgg

SEQ ID NO: 834 - DNA, 24 bp, Homo sapiens
gaaggttctgtctttatttacaat

SEQ ID NO: 835 - DNA, 24 bp, Homo sapiens
gaaggttctgtctttatttacaat

SEQ ID NO: 836 - DNA, 24 bp, Homo sapiens
cgaggtggtaaagtcagcaagtta

SEQ ID NO: 837 - DNA, 24 bp, Homo sapiens
cgaggtggtaaagtcagcaagtta

SEQ ID NO: 838 - DNA, 24 bp, Homo sapiens
atctcttagtcttagcatctatca

SEQ ID NO: 839 - DNA, 24 bp, Homo sapiens
atctcttagtcttagcatctatca

SEQ ID NO: 840 - DNA, 26 bp, Homo sapiens
ggtattggcaactaaaacgattcctc

SEQ ID NO: 841 - DNA, 26 bp, Homo sapiens
ggtattggcaactaaaacgattcctc

SEQ ID NO: 842 - DNA, 24 bp, Homo sapiens
ggtgacagactgagactccattta

SEQ ID NO: 843 - DNA, 24 bp, Homo sapiens
ggtgacagactgagactccattta

SEQ ID NO: 844 - DNA, 23 bp, Homo sapiens
gccttccaccaagtcacaaagac

SEQ ID NO: 845 - DNA, 23 bp, Homo sapiens
gccttccaccaagtcacaaagac

SEQ ID NO: 846 - DNA, 24 bp, Homo sapiens
cagtgaccacagtttctgcctctg

SEQ ID NO: 847 - DNA, 24 bp, Homo sapiens
cagtgaccacagtttctgcctctg

SEQ ID NO: 848 - DNA, 24 bp, Homo sapiens
catttcattctactggattcagat

SEQ ID NO: 849 - DNA, 24 bp, Homo sapiens
catttcattctactggattcagat

SEQ ID NO: 850 - DNA, 26 bp, Homo sapiens
ctcactaatgacatcccacatcgcag

SEQ ID NO: 851 - DNA, 26 bp, Homo sapiens
ctcactaatgacatcccacatcgcag

SEQ ID NO: 852 - DNA, 25 bp, Homo sapiens
agaaagtctcaaacagaaggcaaat

SEQ ID NO: 853 - DNA, 25 bp, Homo sapiens
agaaagtctcaaacagaaggcaaat

SEQ ID NO: 854 - DNA, 26 bp, Homo sapiens
gggttagtaggagaaatgtaaaactc

SEQ ID NO: 855 - DNA, 26 bp, Homo sapiens
gggttagtaggagaaatgtaaaactc

SEQ ID NO: 856 - DNA, 26 bp, Homo sapiens
aaagtgctaagtttgtgaggtgatag

SEQ ID NO: 857 - DNA, 26 bp, Homo sapiens
aaagtgctaagtttgtgaggtgatag

SEQ ID NO: 858 - DNA, 26 bp, Homo sapiens
cctaacacctgccaagaaagtgctaa

SEQ ID NO: 859 - DNA, 26 bp, Homo sapiens
cctaacacctgccaagaaagtgctaa

SEQ ID NO: 860 - DNA, 60 bp, Homo sapiens
aaaatcagttaattggaattaatataattcgattactgaagagtccattagagtaagcag

SEQ ID NO: 861 - DNA, 60 bp, Homo sapiens; identical to SEQ ID NO: 860

SEQ ID NO: 862 - DNA, 60 bp, Homo sapiens
ctaagcagagactaagaatatcttaaagtcgattttatttttttttaaggatctgttaca

SEQ ID NO: 863 - DNA, 60 bp, Homo sapiens; identical to SEQ ID NO: 862

SEQ ID NO: 864 - DNA, 60 bp, Homo sapiens
ttttatatgtttaacagaatagtatatatcgaaactggtttatgtataaaatattaggac

SEQ ID NO: 865 - DNA, 60 bp, Homo sapiens; identical to SEQ ID NO: 864

SEQ ID NO: 866 - DNA, 60 bp, Homo sapiens
gaggcgggtgattcacaaggtcagatgttcgatttgggtatatctaatgttttctcatga

SEQ ID NO: 867 - DNA, 60 bp, Homo sapiens; identical to SEQ ID NO: 866

SEQ ID NO: 868 - DNA, 60 bp, Homo sapiens
gctgattgttgctatattggaatttggatcgaatttattggcatataattgttcatagca

SEQ ID NO: 869 - DNA, 60 bp, Homo sapiens; identical to SEQ ID NO: 868

SEQ ID NO: 870 - DNA, 60 bp, Homo sapiens
aagaatatcatcctggaagttaggaaattcgagtagctatctgtttcttctatatctaaa

SEQ ID NO: 871 - DNA, 60 bp, Homo sapiens; identical to SEQ ID NO: 870

SEQ ID NO: 872 - DNA, 60 bp, Homo sapiens
tatatggtacatattatacatatttctatcgatctcatttgtccatttgcaaatggaaac

SEQ ID NO: 873 - DNA, 60 bp, Homo sapiens; identical to SEQ ID NO: 872

SEQ ID NO: 874 - DNA, 60 bp, Homo sapiens
ttgaaactttaactctgtcaagatgttatcgaaggtatcaatatctgtgtagttgtatga

SEQ ID NO: 875 - DNA, 60 bp, Homo sapiens; identical to SEQ ID NO: 874

SEQ ID NO: 876 - DNA, 60 bp, Homo sapiens
cctaccagaactcttaaatctataatattcgattcttgattaaataatcttttattttca

SEQ ID NO: 877 - DNA, 60 bp, Homo sapiens; identical to SEQ ID NO: 876

SEQ ID NO: 878 - DNA, 60 bp, Homo sapiens
tgaaaataaaagattatttaatcaagaatcgatatattctacaaactgctttattgtaga

SEQ ID NO: 879 - DNA, 60 bp, Homo sapiens; identical to SEQ ID NO: 878

SEQ ID NO: 880 - DNA, 60 bp, Homo sapiens
tataagacagtaatttcagaattactgttcgattagcactgattttgaatgtttcaaaag

SEQ ID NO: 881 - DNA, 60 bp, Homo sapiens; identical to SEQ ID NO: 880

SEQ ID NO: 882 - DNA, 60 bp, Homo sapiens
ccacggaggggtccttctgaactgcaattcgatacaggtatgcaagttcttattttttgt

SEQ ID NO: 883 - DNA, 60 bp, Homo sapiens; identical to SEQ ID NO: 882

SEQ ID NO: 884 - DNA, 60 bp, Homo sapiens
attaaatataacctattatccttatcactcgagaaaagtctgaactaaatctgttaaggt

SEQ ID NO: 885 - DNA, 60 bp, Homo sapiens; identical to SEQ ID NO: 884

SEQ ID NO: 886 - DNA, 60 bp, Homo sapiens
atttttaattattaaaaaataatgtttttcgacaggttaaggataaagagaaaatattaa

SEQ ID NO: 887 - DNA, 60 bp, Homo sapiens; identical to SEQ ID NO: 886

SEQ ID NO: 888 - DNA, 60 bp, Homo sapiens
aggtaattaagacaagaaagacatttattcgatatacattctttgtacttattgttgata

SEQ ID NO: 889 - DNA, 60 bp, Homo sapiens; identical to SEQ ID NO: 888

SEQ ID NO: 890 - DNA, 60 bp, Homo sapiens
gtcataaaatattaccagaaaagcatattcgaactctttatattcttttatattttcata

SEQ ID NO: 891 - DNA, 60 bp, Homo sapiens; identical to SEQ ID NO: 890

SEQ ID NO: 892 - DNA, 60 bp, Homo sapiens
cgtaatgttatttttaaaaacgtacttttcgatgtctaatgagacagtggaattctactt

SEQ ID NO: 893 - DNA, 60 bp, Homo sapiens; identical to SEQ ID NO: 892

SEQ ID NO: 894 - DNA, 60 bp, Homo sapiens
aagttttttttcgctatagttacagtactcgaattgggtgatttgagtagagtttaatca

SEQ ID NO: 895 - DNA, 60 bp, Homo sapiens; identical to SEQ ID NO: 894

SEQ ID NO: 896 - DNA, 60 bp, Homo sapiens
gaggcgggtgattcacaaggtcagatgttcgatatcacagaactcataaaagttaaaatg

SEQ ID NO: 897 - DNA, 60 bp, Homo sapiens; identical to SEQ ID NO: 896

SEQ ID NO: 898 - DNA, 60 bp, Homo sapiens
ttttaaatttttattatgattattattttcgattaataagatgttttcagacactggaac

SEQ ID NO: 899 - DNA, 60 bp, Homo sapiens; identical to SEQ ID NO: 898

SEQ ID NO: 900 - DNA, 60 bp, Homo sapiens
aaagtcatacaactactatgtaagatattcgatttcccacatggaatatacagatttagc

SEQ ID NO: 901 - DNA, 60 bp, Homo sapiens; identical to SEQ ID NO: 900

SEQ ID NO: 902 - DNA, 60 bp, Homo sapiens
acagaattaaattgtatgtcaagttacttcgaaaggtctttctagtgatacatttaaact

SEQ ID NO: 903 - DNA, 60 bp, Homo sapiens; identical to SEQ ID NO: 902

SEQ ID NO: 904 - DNA, 60 bp, Homo sapiens
agatgataaacaatgcatttggaatatatcgattttaaatttattcctaatttctaaggt

SEQ ID NO: 905 - DNA, 60 bp, Homo sapiens; identical to SEQ ID NO: 904

SEQ ID NO: 906 - DNA, 60 bp, Homo sapiens
ttacattaaatagcaattaaaacatttttcgaaaacaaatagataagatttaattgtagt

SEQ ID NO: 907 - DNA, 60 bp, Homo sapiens; identical to SEQ ID NO: 906

SEQ ID NO: 908 - DNA, 60 bp, Homo sapiens
aactcttccataaagatttatcaaaaattcgaaaagaagaacaagaaaaagcctaattcc

SEQ ID NO: 909 - DNA, 60 bp, Homo sapiens; identical to SEQ ID NO: 908

SEQ ID NO: 910 - DNA, 60 bp, Homo sapiens
ttaaaaaagatttaaaaagtcaaaagagtcgaagttattaaatttccatctaaaattcca

SEQ ID NO: 911 - DNA, 60 bp, Homo sapiens; identical to SEQ ID NO: 910

SEQ ID NO: 912 - DNA, 60 bp, Homo sapiens
tatctctatgtaataatcactaaaagtatcgaaaatactgtacaatagtctcaggatttg

SEQ ID NO: 913 - DNA, 60 bp, Homo sapiens; identical to SEQ ID NO: 912

SEQ ID NO: 914 - DNA, 60 bp, Homo sapiens
atgtatatttttcatctaatatacaaagtcgatgttcacacaatgccaaaattgtgtaag

SEQ ID NO: 915 - DNA, 60 bp, Homo sapiens; identical to SEQ ID NO: 914

SEQ ID NO: 916 - DNA, 60 bp, Homo sapiens
ccacggaggggtccttctgaactgcaattcgattagtggttattttatttctataatttc

SEQ ID NO: 917 - DNA, 60 bp, Homo sapiens; identical to SEQ ID NO: 916

SEQ ID NO: 918 - DNA, 60 bp, Homo sapiens
tgaaggttagattttcttaataacattttcgagtactactttgaagataagacattttgt

SEQ ID NO: 919 - DNA, 60 bp, Homo sapiens; identical to SEQ ID NO: 918

SEQ ID NO: 920 - DNA, 60 bp, Homo sapiens
ataaataatgacaagttattttatgtaatcgagacccctcaaaagatattttcagacttt

SEQ ID NO: 921 - DNA, 60 bp, Homo sapiens; identical to SEQ ID NO: 920

SEQ ID NO: 922 - DNA, 60 bp, Homo sapiens
gaagtatttcatttaaaaaaaaatcaaatcgatgtattttttgacttaatgatcagtgtt

SEQ ID NO: 923 - DNA, 60 bp, Homo sapiens; identical to SEQ ID NO: 922

SEQ ID NO: 924 - DNA, 60 bp, Homo sapiens; identical to SEQ ID NO: 908

SEQ ID NO: 925 - DNA, 60 bp, Homo sapiens; identical to SEQ ID NO: 908

SEQ ID NO: 926 - DNA, 60 bp, Homo sapiens
tgtaatataattttttctttgagatttctcgatagcaagtacttatgcctattcccaagt

SEQ ID NO: 927 - DNA, 60 bp, Homo sapiens; identical to SEQ ID NO: 926

SEQ ID NO: 928 - DNA, 60 bp, Homo sapiens
gtggagtttatcttaaccacttttacaatcgaataagtacttcatttgctgtatgccctt

SEQ ID NO: 929 - DNA, 60 bp, Homo sapiens; identical to SEQ ID NO: 928

SEQ ID NO: 930 - DNA, 60 bp, Homo sapiens
aataatttctcaatactctagaaagatatcgacttaggtaaaaaacttgacaagagacaa

SEQ ID NO: 931 - DNA, 60 bp, Homo sapiens; identical to SEQ ID NO: 930

SEQ ID NO: 932 - DNA, 60 bp, Homo sapiens
gtgatgaaacttaaaaaaaaattttttttcgaattttaaaaaatggttaattgcttctag

SEQ ID NO: 933 - DNA, 60 bp, Homo sapiens; identical to SEQ ID NO: 932

SEQ ID NO: 934 - DNA, 26 bp, Homo sapiens
tggttaggttcaaactcaggtagcct

SEQ ID NO: 935 - DNA, 26 bp, Homo sapiens
tggttaggttcaaactcaggtagcct

SEQ ID NO: 936 - DNA, 26 bp, Homo sapiens
aaggcagaggataagatagtggtctc

SEQ ID NO: 937 - DNA, 26 bp, Homo sapiens
aaggcagaggataagatagtggtctc

SEQ ID NO: 938 - DNA, 23 bp, Homo sapiens
gccttccctgccttcttacttcc

SEQ ID NO: 939 - DNA, 23 bp, Homo sapiens
gccttccctgccttcttacttcc

SEQ ID NO: 940 - DNA, 23 bp, Homo sapiens
cgcctgtaaccccagcattttgg

SEQ ID NO: 941 - DNA, 23 bp, Homo sapiens
cgcctgtaaccccagcattttgg

SEQ ID NO: 942 - DNA, 26 bp, Homo sapiens
acagggactgagcaggtcgctgaaaa

SEQ ID NO: 943 - DNA, 26 bp, Homo sapiens
acagggactgagcaggtcgctgaaaa

SEQ ID NO: 944 - DNA, 26 bp, Homo sapiens
atcctcagaatgggtccgtctcagag

SEQ ID NO: 945 - DNA, 26 bp, Homo sapiens
atcctcagaatgggtccgtctcagag

SEQ ID NO: 946 - DNA, 23 bp, Homo sapiens
cagcacagtggagtggtcgtgac

SEQ ID NO: 947 - DNA, 23 bp, Homo sapiens
cagcacagtggagtggtcgtgac

SEQ ID NO: 948 - DNA, 26 bp, Homo sapiens
gataaaagccctacaagtgctaatca

SEQ ID NO: 949 - DNA, 26 bp, Homo sapiens
gataaaagccctacaagtgctaatca

SEQ ID NO: 950 - DNA, 26 bp, Homo sapiens
cttacagccttccaaaataactccag

SEQ ID NO: 951 - DNA, 26 bp, Homo sapiens
cttacagccttccaaaataactccag

SEQ ID NO: 952 - DNA, 26 bp, Homo sapiens
tgccacagcaagtctatcagcatccg

SEQ ID NO: 953 - DNA, 26 bp, Homo sapiens
tgccacagcaagtctatcagcatccg

SEQ ID NO: 954 - DNA, 26 bp, Homo sapiens
cttttacttcagggaccccaggtgtc

SEQ ID NO: 955 - DNA, 26 bp, Homo sapiens
cttttacttcagggaccccaggtgtc

SEQ ID NO: 956 - DNA, 23 bp, Homo sapiens
gccagaagttcacaggcagggtg

SEQ ID NO: 957 - DNA, 23 bp, Homo sapiens
gccagaagttcacaggcagggtg

SEQ ID NO: 958 - DNA, 26 bp, Homo sapiens
ctaccaccaccagcatcccaatacac

SEQ ID NO: 959 - DNA, 26 bp, Homo sapiens
ctaccaccaccagcatcccaatacac

SEQ ID NO: 960 - DNA, 26 bp, Homo sapiens
caggctattggaatggctgaagtgtg

SEQ ID NO: 961 - DNA, 26 bp, Homo sapiens
caggctattggaatggctgaagtgtg

SEQ ID NO: 962 - DNA, 26 bp, Homo sapiens
taccacttgaagggagggttgctttt

SEQ ID NO: 963 - DNA, 26 bp, Homo sapiens
taccacttgaagggagggttgctttt

SEQ ID NO: 964 - DNA, 26 bp, Homo sapiens
ttggagggagaatacaaagagtgagc

SEQ ID NO: 965 - DNA, 26 bp, Homo sapiens
ttggagggagaatacaaagagtgagc

SEQ ID NO: 966 - DNA, 26 bp, Homo sapiens
tgtagagccaaatagccacagggata

SEQ ID NO: 967 - DNA, 26 bp, Homo sapiens
tgtagagccaaatagccacagggata

SEQ ID NO: 968 - DNA, 23 bp, Homo sapiens
ctggacctttccttggctgccct

SEQ ID NO: 969 - DNA, 23 bp, Homo sapiens
ctggacctttccttggctgccct

SEQ ID NO: 970 - DNA, 23 bp, Homo sapiens
cgcctgtaaccccagcattttgg

SEQ ID NO: 971 - DNA, 23 bp, Homo sapiens
cgcctgtaaccccagcattttgg

SEQ ID NO: 972 - DNA, 23 bp, Homo sapiens
ctgttcaaacccgtcagcaggat

SEQ ID NO: 973 - DNA, 23 bp, Homo sapiens
ctgttcaaacccgtcagcaggat

SEQ ID NO: 974 - DNA, 24 bp, Homo sapiens
aaaccagtcaatcctcaagtgtgc

SEQ ID NO: 975 - DNA, 24 bp, Homo sapiens
aaaccagtcaatcctcaagtgtgc

SEQ ID NO: 976 - DNA, 26 bp, Homo sapiens
cgtgtcttttctctgggacctgtgat

SEQ ID NO: 977 - DNA, 26 bp, Homo sapiens
cgtgtcttttctctgggacctgtgat

SEQ ID NO: 978 - DNA, 24 bp, Homo sapiens
ggaaaagagataaacacacaaata

SEQ ID NO: 979 - DNA, 24 bp, Homo sapiens
ggaaaagagataaacacacaaata

SEQ ID NO: 980 - DNA, 26 bp, Homo sapiens
caatctaatgatgtccctccactgct

SEQ ID NO: 981 - DNA, 26 bp, Homo sapiens
caatctaatgatgtccctccactgct

SEQ ID NO: 982 - DNA, 26 bp, Homo sapiens
gcctcctgatgcttccttcgtgcccc

SEQ ID NO: 983 - DNA, 26 bp, Homo sapiens
gcctcctgatgcttccttcgtgcccc

SEQ ID NO: 984 - DNA, 26 bp, Homo sapiens
acacatccactgataggcaacaactg

SEQ ID NO: 985 - DNA, 26 bp, Homo sapiens
acacatccactgataggcaacaactg

SEQ ID NO: 986 - DNA, 26 bp, Homo sapiens
catttctctgctgccatctcgtggat

SEQ ID NO: 987 - DNA, 26 bp, Homo sapiens
catttctctgctgccatctcgtggat

SEQ ID NO: 988 - DNA, 24 bp, Homo sapiens
atcacctcagcagataggcattta

SEQ ID NO: 989 - DNA, 24 bp, Homo sapiens
atcacctcagcagataggcattta

SEQ ID NO: 990 - DNA, 23 bp, Homo sapiens
gccagaagttcacaggcagggtg

SEQ ID NO: 991 - DNA, 23 bp, Homo sapiens
gccagaagttcacaggcagggtg

SEQ ID NO: 992 - DNA, 26 bp, Homo sapiens
gaagtttcaaataggcaagccaaccc

SEQ ID NO: 993 - DNA, 26 bp, Homo sapiens
gaagtttcaaataggcaagccaaccc

SEQ ID NO: 994 - DNA, 24 bp, Homo sapiens
tatggcactgtgggaggtaatggg

SEQ ID NO: 995 - DNA, 24 bp, Homo sapiens
tatggcactgtgggaggtaatggg

SEQ ID NO: 996 - DNA, 24 bp, Homo sapiens
gtttattacctttcactgccagat

SEQ ID NO: 997 - DNA, 24 bp, Homo sapiens
gtttattacctttcactgccagat

SEQ ID NO: 998 - DNA, 26 bp, Homo sapiens
gcctcctgatgcttccttcgtgcccc

SEQ ID NO: 999 - DNA, 26 bp, Homo sapiens
gcctcctgatgcttccttcgtgcccc

SEQ ID NO: 1000 - DNA, 25 bp, Homo sapiens
gattgagggaagaatacaagaacta

SEQ ID NO: 1001 - DNA, 25 bp, Homo sapiens
gattgagggaagaatacaagaacta

SEQ ID NO: 1002 - DNA, 26 bp, Homo sapiens
agcactcttcctcctgactgtgagaa

SEQ ID NO: 1003 - DNA, 26 bp, Homo sapiens
agcactcttcctcctgactgtgagaa

SEQ ID NO: 1004 - DNA, 26 bp, Homo sapiens
cctccctacttttatggcatctctgc

SEQ ID NO: 1005 - DNA, 26 bp, Homo sapiens
cctccctacttttatggcatctctgc

SEQ ID NO: 1006 - DNA, 26 bp, Homo sapiens
gcaagttctcttccagttgatttcct

SEQ ID NO: 1007 - DNA, 26 bp, Homo sapiens
gcaagttctcttccagttgatttcct

SEQ ID NO: 1008 - DNA, 26 bp, Homo sapiens
taagtctaccttctctctcctattgc

SEQ ID NO: 1009 - DNA, 26 bp, Homo sapiens
taagtctaccttctctctcctattgc

SEQ ID NO: 1010 - DNA, 26 bp, Homo sapiens
cccgagggatagggattctgttttgt

SEQ ID NO: 1011 - DNA, 26 bp, Homo sapiens
cccgagggatagggattctgttttgt

SEQ ID NO: 1012 - DNA, 23 bp, Homo sapiens
aatctcctctggtcgctcccacc

SEQ ID NO: 1013 - DNA, 23 bp, Homo sapiens
aatctcctctggtcgctcccacc

SEQ ID NO: 1014 - DNA, 26 bp, Homo sapiens
attgccaaaagtgccccaaatgatta

SEQ ID NO: 1015 - DNA, 26 bp, Homo sapiens
attgccaaaagtgccccaaatgatta

SEQ ID NO: 1016 - DNA, 26 bp, Homo sapiens
acacaactgacaaatccttaggtgga

SEQ ID NO: 1017 - DNA, 26 bp, Homo sapiens
acacaactgacaaatccttaggtgga

SEQ ID NO: 1018 - DNA, 26 bp, Homo sapiens
tttccactctccaccctcatttcctt

SEQ ID NO: 1019 - DNA, 26 bp, Homo sapiens
tttccactctccaccctcatttcctt

SEQ ID NO: 1020 - DNA, 24 bp, Homo sapiens
ctatgagggaggcattgttgtttc

SEQ ID NO: 1021 - DNA, 24 bp, Homo sapiens
ctatgagggaggcattgttgtttc

SEQ ID NO: 1022 - DNA, 26 bp, Homo sapiens
gctggctccaacaaaacaggcattct

SEQ ID NO: 1023 - DNA, 26 bp, Homo sapiens
gctggctccaacaaaacaggcattct

SEQ ID NO: 1024 - DNA, 26 bp, Homo sapiens
tgccacagcaagtctatcagcatccg

SEQ ID NO: 1025 - DNA, 26 bp, Homo sapiens
tgccacagcaagtctatcagcatccg

SEQ ID NO: 1026 - DNA, 26 bp, Homo sapiens
gttccatcatagcaggattgggtcat

SEQ ID NO: 1027 - DNA, 26 bp, Homo sapiens
gttccatcatagcaggattgggtcat

SEQ ID NO: 1028 - DNA, 26 bp, Homo sapiens
cacttgatacaataccaacccagaag

SEQ ID NO: 1029 - DNA, 26 bp, Homo sapiens
cacttgatacaataccaacccagaag

SEQ ID NO: 1030 - DNA, 23 bp, Homo sapiens
tcttccaacatcactcccagggc

SEQ ID NO: 1031 - DNA, 23 bp, Homo sapiens
tcttccaacatcactcccagggc

SEQ ID NO: 1032 - DNA, 26 bp, Homo sapiens
ttctgctcacggaacacaaacacctt

SEQ ID NO: 1033 - DNA, 26 bp, Homo sapiens
ttctgctcacggaacacaaacacctt

SEQ ID NO: 1034 - DNA, 26 bp, Homo sapiens
gctgataatagtgtgtgtgggaggag

SEQ ID NO: 1035 - DNA, 26 bp, Homo sapiens
gctgataatagtgtgtgtgggaggag

SEQ ID NO: 1036 - DNA, 26 bp, Homo sapiens
cagtgtctggattgaagtgtaaaggc

SEQ ID NO: 1037 - DNA, 26 bp, Homo sapiens
cagtgtctggattgaagtgtaaaggc

SEQ ID NO: 1038 - DNA, 26 bp, Homo sapiens
gctaaccaccagagtcacacacatca

SEQ ID NO: 1039 - DNA, 26 bp, Homo sapiens
gctaaccaccagagtcacacacatca

SEQ ID NO: 1040 - DNA, 26 bp, Homo sapiens
tctggttcaaggagtggctaaggacc

SEQ ID NO: 1041 - DNA, 26 bp, Homo sapiens
tctggttcaaggagtggctaaggacc

SEQ ID NO: 1042 - DNA, 23 bp, Homo sapiens
gcatcccagcatctacttcccag

SEQ ID NO: 1043 - DNA, 23 bp, Homo sapiens
gcatcccagcatctacttcccag

SEQ ID NO: 1044 - DNA, 26 bp, Homo sapiens
cctggattctaactgtgagtgataaa

SEQ ID NO: 1045 - DNA, 26 bp, Homo sapiens
cctggattctaactgtgagtgataaa

SEQ ID NO: 1046 - DNA, 26 bp, Homo sapiens
atctcagcattattacaaccagttcc

SEQ ID NO: 1047 - DNA, 26 bp, Homo sapiens
atctcagcattattacaaccagttcc

SEQ ID NO: 1048 - DNA, 24 bp, Homo sapiens
ccagaaagaatgatgaatgtgttc

SEQ ID NO: 1049 - DNA, 24 bp, Homo sapiens
ccagaaagaatgatgaatgtgttc

SEQ ID NO: 1050 - DNA, 26 bp, Homo sapiens
gagaacattccttttcctctgtagaa

SEQ ID NO: 1051 - DNA, 26 bp, Homo sapiens
gagaacattccttttcctctgtagaa

SEQ ID NO: 1052 - DNA, 25 bp, Homo sapiens
gaaaatagaggaatgagattagatt

SEQ ID NO: 1053 - DNA, 25 bp, Homo sapiens
gaaaatagaggaatgagattagatt

SEQ ID NO: 1054 - DNA, 26 bp, Homo sapiens
ctctaaaatggctgcttctcagtgac

SEQ ID NO: 1055 - DNA, 26 bp, Homo sapiens
ctctaaaatggctgcttctcagtgac

SEQ ID NO: 1056 - DNA, 28 bp, Homo sapiens
catttccttttctacactgttcattcac

SEQ ID NO: 1057 - DNA, 28 bp, Homo sapiens
catttccttttctacactgttcattcac

SEQ ID NO: 1058 - DNA, 26 bp, Homo sapiens
tatgttacaccccttggctacccagc

SEQ ID NO: 1059 - DNA, 26 bp, Homo sapiens
tatgttacaccccttggctacccagc

SEQ ID NO: 1060 - DNA, 23 bp, Homo sapiens
gcagttggtgctctgtatccaca

SEQ ID NO: 1061 - DNA, 23 bp, Homo sapiens
gcagttggtgctctgtatccaca

SEQ ID NO: 1062 - DNA, 24 bp, Homo sapiens
ttttcggctttgaagactgttgat

SEQ ID NO: 1063 - DNA, 24 bp, Homo sapiens
ttttcggctttgaagactgttgat

SEQ ID NO: 1064 - DNA, 23 bp, Homo sapiens
gcaagcatcggaagcagactcag

SEQ ID NO: 1065 - DNA, 23 bp, Homo sapiens
gcaagcatcggaagcagactcag

SEQ ID NO: 1066 - DNA, 26 bp, Homo sapiens
caatgccaagagcaatgaggctacag

SEQ ID NO: 1067 - DNA, 26 bp, Homo sapiens
caatgccaagagcaatgaggctacag

SEQ ID NO: 1068 - DNA, 23 bp, Homo sapiens
gccaacacggaacacacacaaaa

SEQ ID NO: 1069 - DNA, 23 bp, Homo sapiens
gccaacacggaacacacacaaaa

SEQ ID NO: 1070 - DNA, 24 bp, Homo sapiens
atgaactccacccagcaaatgcct

SEQ ID NO: 1071 - DNA, 24 bp, Homo sapiens
atgaactccacccagcaaatgcct

SEQ ID NO: 1072 - DNA, 28 bp, Homo sapiens
catttccttttctacactgttcattcac

SEQ ID NO: 1073 - DNA, 28 bp, Homo sapiens
catttccttttctacactgttcattcac

SEQ ID NO: 1074 - DNA, 25 bp, Homo sapiens
gtgaagagtggaggttttctacaga

SEQ ID NO: 1075 - DNA, 25 bp, Homo sapiens
gtgaagagtggaggttttctacaga

SEQ ID NO: 1076 - DNA, 26 bp, Homo sapiens
atggacgaccctcttcccagcaaaat

SEQ ID NO: 1077 - DNA, 26 bp, Homo sapiens
atggacgaccctcttcccagcaaaat

SEQ ID NO: 1078 - DNA, 26 bp, Homo sapiens
ttatgtctcccttcagttccatcaat

SEQ ID NO: 1079 - DNA, 26 bp, Homo sapiens
ttatgtctcccttcagttccatcaat

SEQ ID NO: 1080 - DNA, 26 bp, Homo sapiens
tttgtatccaaccccttccccagagc

SEQ ID NO: 1081 - DNA, 26 bp, Homo sapiens
tttgtatccaaccccttccccagagc

SEQ ID NO: 1082 - DNA, 60 bp, Homo sapiens
aaactcaatgatagaattattaaggatttcgacattttaaaagggcacttggaatttcac

SEQ ID NO: 1083 - DNA, 60 bp, Homo sapiens
ttttccagtcctattttctatggcaatgtcgaaagtctttgaaaataaactcacctaacg

SEQ ID NO: 1084 - DNA, 60 bp, Homo sapiens
ctaaaatgaatcctaaaggtctttttgttcgattttgaaaagcacatgtttccttccttt

SEQ ID NO: 1085 - DNA, 60 bp, Homo sapiens
actgaattctcacaaccatcctggtgtttcgaataaaagaatctggatctattaaatgtc

SEQ ID NO: 1086 - DNA, 60 bp, Homo sapiens
taatgataaaaaaatcaaataaaaactgtcgatagtgataaagacatactcataaaatat

SEQ ID NO: 1087 - DNA, 60 bp, Homo sapiens
agttgaaggcatcacatatgttctgatttcgaaatgttaagtgttttaaaaacaactttc

SEQ ID NO: 1088 - DNA, 60 bp, Homo sapiens
aatatggagagcaaaaaaaaaaagcctctcgaaacagaggtatcaagtcctttgttgcaa

SEQ ID NO: 1089 - DNA, 60 bp, Homo sapiens
ttcatgagtcatagtcaattatataatctcgatgtgacaagtgcttttaaacaagagatt

SEQ ID NO: 1090 - DNA, 60 bp, Homo sapiens
tgtttcacaaatagaataagaccatttctcgatatttcgtcttactctgccccacctcca

SEQ ID NO: 1091 - DNA, 60 bp, Homo sapiens
acatttattccctaatactcttctctgttcgaaccagaagaacattgtccttaaaccaga

SEQ ID NO: 1092 - DNA, 60 bp, Homo sapiens
ccagcttattctaagtcctcaataaatctcgagaacagctactttctatcttctgttaca

SEQ ID NO: 1093 - DNA, 60 bp, Homo sapiens
aaactttaaaacaaaatgaagttctaattcgaaggctctttctctagctttttcctttgg

SEQ ID NO: 1094 - DNA, 60 bp, Homo sapiens
gactcaactacaaataactacaacctcttcgacatttgcatttaaattgctttgagcctt

SEQ ID NO: 1095 - DNA, 60 bp, Homo sapiens
aacatttgcaacttgatgatattatgtttcgaaggataaaaccactaagcattatattta

SEQ ID NO: 1096 - DNA, 60 bp, Homo sapiens
cgtaatgttatttttaaaaacgtacttttcgaggcattccaataaaaataagtaaattct

SEQ ID NO: 1097 - DNA, 60 bp, Homo sapiens
gaccacaaagtgaaggtaaaaataaaattcgactttacaaataataataatagtccaatg

SEQ ID NO: 1098 - DNA, 60 bp, Homo sapiens
aaatatcaggagaatccacatagtagtctcgaacatcagacttgaatttcttgttttgga

SEQ ID NO: 1099 - DNA, 60 bp, Homo sapiens
ctatatttgcttcataattttttctttttcgacttaacaacttgtataggtttggtatta

SEQ ID NO: 1100 - DNA, 60 bp, Homo sapiens
actcttcaaaattataattatcaacaattcgattttgttacttgttattggtcttttcag

SEQ ID NO: 1101 - DNA, 60 bp, Homo sapiens
tctttgttaggttttctcttatgttctttcgaagtctaacttgaatatctattactttta

SEQ ID NO: 1102 - DNA, 60 bp, Homo sapiens
aacaaaataaagcttgacttttaacaaatcgatgtagtctttgtggccaatctttatcac

SEQ ID NO: 1103 - DNA, 60 bp, Homo sapiens
caatatcctttgtattattttctttacttcgaatccatgggctctgaaacaaaaccattt

SEQ ID NO: 1104 - DNA, 60 bp, Homo sapiens
gaattatcaaattatattccaggtttgttcgatatctctgctcaatttttaaaatgctat

SEQ ID NO: 1105 - DNA, 60 bp, Homo sapiens
tacgttaattaaataaatttgtgctcactcgaaacaggttggttttacacaaagaggtgt

SEQ ID NO: 1106 - DNA, 60 bp, Homo sapiens
aaaaatatatttatcaaacaacagtctttcgagaggggccgggcccggcacccaccgcat

SEQ ID NO: 1107 - DNA, 60 bp, Homo sapiens
cctagaagagatcaaggtagaaagactatcgagaggacataaataagttctacctacttc

SEQ ID NO: 1108 - DNA, 60 bp, Homo sapiens
agccatagggaatttaaataacttctgttcgattatgtcacatgtaacatgagtgattcc

SEQ ID NO: 1109 - DNA, 60 bp, Homo sapiens
tcaaattctcattttttaaggtttattttcgaagaatctcaggatcattcaggcctttaa

SEQ ID NO: 1110 - DNA, 60 bp, Homo sapiens
cagaaaattcaaataaactgttaaaatttcgatagatcctaatattactatttagtgggc

SEQ ID NO: 1111 - DNA, 60 bp, Homo sapiens
acttgcagacaaatgtcttcaaattcattcgatgttatagaatcttgatccttcatcata

SEQ ID NO: 1112 - DNA, 60 bp, Homo sapiens
atatttttttttttttgtattcccagaatcgaaaagaagttctttttatcccaaaggagt

SEQ ID NO: 1113 - DNA, 60 bp, Homo sapiens
tattgagttttaagtgttttgtatattttcgatactgggttcaaatctcaattttatttt

SEQ ID NO: 1114 - DNA, 60 bp, Homo sapiens
ctacagtatatcatctaagatgtcttcttcgactaacgtttacttggcacttgatgtttt

SEQ ID NO: 1115 - DNA, 60 bp, Homo sapiens
aaagaagaaaaaaatgaaataattggtttcgacagaagctagttataatgtcgttattat

SEQ ID NO: 1116 - DNA, 60 bp, Homo sapiens
ataataataaataacattaaagttaaactcgagatgctcttattctctgggcttcatatt

SEQ ID NO: 1117 - DNA, 60 bp, Homo sapiens
acacccatttttaggaatattacagttgtcgattgtattttgacaggaaagcagaatgta

SEQ ID NO: 1118 - DNA, 60 bp, Homo sapiens
tatttttctttatctgaatttataactttcgatttttttcatgctcctctccaattctgt

SEQ ID NO: 1119 - DNA, 60 bp, Homo sapiens
tattacagaaaaaaaaaaatggatctcttcgaaaaattttgagagtagtcatctgctggg

SEQ ID NO: 1120 - DNA, 60 bp, Homo sapiens
tagtactaattggtatccttttgtaacttcgacctttctccatttgggccaaatgcccag

SEQ ID NO: 1121 - DNA, 60 bp, Homo sapiens
actcctttcaatcagttgaatcaacaaatcgaacacagaagtatttatctgaaaagtgga

SEQ ID NO: 1122 - DNA, 60 bp, Homo sapiens
gcccactaaatagtaatattaggatctatcgaatttgtgcttgttgggaaaatagtaatt

SEQ ID NO: 1123 - DNA, 60 bp, Homo sapiens
catatggatgatttctacaaatatattatcgagacttatcaaattgtatactttatatat

SEQ ID NO: 1124 - DNA, 60 bp, Homo sapiens
caaaatcctgaggaaagtttctaatttatcgaactgcaaaccatcaaagttaccaggaaa

SEQ ID NO: 1125 - DNA, 60 bp, Homo sapiens
cttgactgtgttgtattttttgtttttttcgactgactgattaaaacattcattatctga

SEQ ID NO: 1126 - DNA, 60 bp, Homo sapiens
tacatttttagctcatcataaaagatattcgacttttttggcgttaattctcactgggaa

SEQ ID NO: 1127 - DNA, 60 bp, Homo sapiens
acagattaaaactatgaggatataccattcgagtaatattaaagattccaggactcacaa

SEQ ID NO: 1128 - DNA, 60 bp, Homo sapiens
ttttttgttgtttttttttaatactccctcgatagtatatataagacaggaatatgtgtg

SEQ ID NO: 1129 - DNA, 60 bp, Homo sapiens
tacaattttgatgagcattataaagaaatcgaatgctgttattttccagagttaattagg

SEQ ID NO: 1130 - DNA, 60 bp, Homo sapiens
aatatataaaatgatgtggaataatgtttcgattattcaggaaaaactcctttacaaaaa

SEQ ID NO: 1131 - DNA, 60 bp, Homo sapiens
gttaaaattatttaaaatattacacttatcgaatgcattttgtgactatagagggtggct

SEQ ID NO: 1132 - DNA, 60 bp, Homo sapiens
tatttcattctttcaacaaatatttgactcgagttgtttcatttttttagacattggttt

SEQ ID NO: 1133 - DNA, 60 bp, Homo sapiens
tctctgaatgtcttttgaatctaccatatcgaatagcaagcatgcaacaatgcttgtgac

SEQ ID NO: 1134 - DNA, 60 bp, Homo sapiens
ttaaatcaaaatctttgactcttaaaaatcgaaaggtaaggcagagtgagatggaatcta

SEQ ID NO: 1135 - DNA, 60 bp, Homo sapiens
catttgcagatttgttaatagtataaaatcgattggccatatcctttcttgcccaccata

SEQ ID NO: 1136 - DNA, 60 bp, Homo sapiens
caccttggttataatgtatttttaaatttcgagatcagcttggtaaaaccctatctctac

SEQ ID NO: 1137 - DNA, 60 bp, Homo sapiens
cttttaaaaggtttcttgcttttctgactcgatttaaagaacttctgaagtggtgatcca

SEQ ID NO: 1138 - DNA, 60 bp, Homo sapiens
agtccttattgagtgatctttatattactcgaaaaactcttatcaggataagaataatgg

SEQ ID NO: 1139 - DNA, 60 bp, Homo sapiens
gtaaaaacaaagcaaattcttcaaaatttcgagttgtttccaataattttaaaagatggc

SEQ ID NO: 1140 - DNA, 60 bp, Homo sapiens
aatgaaactgtaagtttccccaattaaatcgaatgtttaaaattttggtgaattgttatt

SEQ ID NO: 1141 - DNA, 60 bp, Homo sapiens
gagacaactcaatattaataatgcagattcgatgagtttctgtattcaggattggtgttt

SEQ ID NO: 1142 - DNA, 60 bp, Homo sapiens
caaacattctgactacaatacagtattatcgattttcaccttcttcttgcctttgccttt

SEQ ID NO: 1143 - DNA, 60 bp, Homo sapiens
aacaataaatccctaatatcatcaaatatcgattttagtatgacaactaagaacataaaa

SEQ ID NO: 1144 - DNA, 60 bp, Homo sapiens
atattatgttctagaaaaggtagaattatcgagatttactcataggcactgagtttcaaa

SEQ ID NO: 1145 - DNA, 60 bp, Homo sapiens
ctatattatctgcatttttcaaattcattcgacttgggtagaaacaataatagctaacac

SEQ ID NO: 1146 - DNA, 60 bp, Homo sapiens
gaacaaattttgttttacaatttggtcctcgatgaatttaatccagccacatttattatg

SEQ ID NO: 1147 - DNA, 60 bp, Homo sapiens
ggaaagtataaaattctgaattttcatgtcgacttatgatttttcaactttatgatggtg

SEQ ID NO: 1148 - DNA, 60 bp, Homo sapiens
ttatattggaaatctgtttcaacaataatcgaaacaacaccaaataagcttttcctctta

SEQ ID NO: 1149 - DNA, 60 bp, Homo sapiens
atagaaattgtttacagaatgattttattcgagctatgagctgttctattttcttcctgt

SEQ ID NO: 1150 - DNA, 60 bp, Homo sapiens
acatttattccctaatactcttctctgttcgacaaaattatccttcaaaaatgaaggaga

SEQ ID NO: 1151 - DNA, 60 bp, Homo sapiens
cacaaaactgaatttatttttatcgtcttcgacagagctacattaaaaaggagaatctcc

SEQ ID NO: 1152 - DNA, 60 bp, Homo sapiens
ctgctaattttaattcactaagaaactatcgatataccataggtgtatagtaggttatgc

SEQ ID NO: 1153 - DNA, 60 bp, Homo sapiens
aatttctctttacagcctttaaaatttatcgatgttatagagtcactcttattgctcctg

SEQ ID NO: 1154 - DNA, 60 bp, Homo sapiens
tctatataagaaattcgtaggatgaatatcgaataatctacccatggacatttgtatcac

SEQ ID NO: 1155 - DNA, 60 bp, Homo sapiens
tttagtattagaaatgttttggtctttatcgaaaaacatggctctgaaacccaagcttat

SEQ ID NO: 1156 - DNA, 60 bp, Homo sapiens
cactctagtccactactagttgcaatgttcgaatcatggacagatgagaggtttcaagca

SEQ ID NO: 1157 - DNA, 60 bp, Homo sapiens
aatgaaactgtaagtttccccaattaaatcgaatccgtaaattctaacacctcccttctt

SEQ ID NO: 1158 - DNA, 60 bp, Homo sapiens
cttaatcaattggagtttaacctttggttcgatttttcaatgtttgtgacaaaaccggtt

SEQ ID NO: 1159 - DNA, 60 bp, Homo sapiens
aaaacacctaaaattaagcaaagtattttcgatcataaaattatgttaagcaaagaatta

SEQ ID NO: 1160 - DNA, 60 bp, Homo sapiens
acttttgtgattttatgatttgtaattgtcgagtatatagagggacatcagtattcttac

SEQ ID NO: 1161 - DNA, 60 bp, Homo sapiens
aagcaaacaatgaaattgaagggaaatatcgagattttaataggaattgcactgaatcta

SEQ ID NO: 1162 - DNA, 60 bp, Homo sapiens
cacaatgatgctcaccgtcgtgtgagcttcgaccctagttcctgacacgtaaatatttga

SEQ ID NO: 1163 - DNA, 60 bp, Homo sapiens
taaaaatgattttcaagacgtggaaaattcgattttaatgaacagtatcaagtgcaaaaa

SEQ ID NO: 1164 - DNA, 23 bp, Homo sapiens
tggagaggtggagggaggtagga

SEQ ID NO: 1165 - DNA, 26 bp, Homo sapiens
caactgtgacttgactccttgctaag

SEQ ID NO: 1166 - DNA, 24 bp, Homo sapiens
attgactaacaacaacaagaaagc

SEQ ID NO: 1167 - DNA, 23 bp, Homo sapiens
gcccctcttctttgccaagcact

SEQ ID NO: 1168 - DNA, 26 bp, Homo sapiens
acaagagatgctccacaatacatttg

SEQ ID NO: 1169 - DNA, 24 bp, Homo sapiens
gaaagtaatcttattgacgatagc

SEQ ID NO: 1170 - DNA, 26 bp, Homo sapiens
gcataagagaatgactcaaacgctgc

SEQ ID NO: 1171 - DNA, 26 bp, Homo sapiens
tcccaagtggtccccaaaatgtcttt

SEQ ID NO: 1172 - DNA, 23 bp, Homo sapiens
gggacagtgtggtctccagaatc

SEQ ID NO: 1173 - DNA, 24 bp, Homo sapiens
aagtcagaaagccacaagataaat

SEQ ID NO: 1174 - DNA, 23 bp, Homo sapiens
gccctctactgcctcaggttctt

SEQ ID NO: 1175 - DNA, 26 bp, Homo sapiens
cacatagttgcttctcttcaaggtgt

SEQ ID NO: 1176 - DNA, 26 bp, Homo sapiens
gcagacaggagataagagccatcagg

SEQ ID NO: 1177 - DNA, 23 bp, Homo sapiens
ccagtgagcataaacaaccctct

SEQ ID NO: 1178 - DNA, 26 bp, Homo sapiens
tgtagagccaaatagccacagggata

SEQ ID NO: 1179 - DNA, 24 bp, Homo sapiens
tgaaagaaagaggttgtcaagaat

SEQ ID NO: 1180 - DNA, 26 bp, Homo sapiens
atgtctttatcttgcttcctttaggg

SEQ ID NO: 1181 - DNA, 26 bp, Homo sapiens
gaataagcacttcttcttggattagc

SEQ ID NO: 1182 - DNA, 24 bp, Homo sapiens
acaaaatagaaccctggtcccacc

SEQ ID NO: 1183 - DNA, 24 bp, Homo sapiens
tgcctggctgatgtttcttggata

SEQ ID NO: 1184 - DNA, 26 bp, Homo sapiens
gcatcatttgaaaccttggtggctgc

SEQ ID NO: 1185 - DNA, 23 bp, Homo sapiens
gttgagtttggtctccctgcccc

SEQ ID NO: 1186 - DNA, 26 bp, Homo sapiens
ccttagagccaatcattacagcgttc

SEQ ID NO: 1187 - DNA, 26 bp, Homo sapiens
cacagtgggctcagtgtcaacaaacc

SEQ ID NO: 1188 - DNA, 23 bp, Homo sapiens
gacagagcaagactccatctcaa

SEQ ID NO: 1189 - DNA, 25 bp, Homo sapiens
cagcaaactggcatagcacaatctc

SEQ ID NO: 1190 - DNA, 23 bp, Homo sapiens
cacactggcattccctattgggc

SEQ ID NO: 1191 - DNA, 23 bp, Homo sapiens
ctgaatggtgtgtcgcagagcag

SEQ ID NO: 1192 - DNA, 26 bp, Homo sapiens
gacatagaataatctccatccattgc

SEQ ID NO: 1193 - DNA, 26 bp, Homo sapiens
agccaacaatacacagagcaggacag

SEQ ID NO: 1194 - DNA, 23 bp, Homo sapiens
cctcacacagtcctcttcccacc

SEQ ID NO: 1195 - DNA, 26 bp, Homo sapiens
ccaccagcagttattgagcattcctt

SEQ ID NO: 1196 - DNA, 24 bp, Homo sapiens
ccagcaaaaggcaggaatcagtgc

SEQ ID NO: 1197 - DNA, 23 bp, Homo sapiens
cctgtcagtggtgggtaggaggg

SEQ ID NO: 1198 - DNA, 24 bp, Homo sapiens
cttgataataaacgcagcagaaat

SEQ ID NO: 1199 - DNA, 26 bp, Homo sapiens
gagactgaggttgcttccaatgttcc

SEQ ID NO: 1200 - DNA, 26 bp, Homo sapiens
cagtggtaatctatgggtggtaggaa

SEQ ID NO: 1201 - DNA, 26 bp, Homo sapiens
tttgtcacagggtccataactgggtt

SEQ ID NO: 1202 - DNA, 26 bp, Homo sapiens
ggtcattcctctctcactgtgtttca

SEQ ID NO: 1203 - DNA, 26 bp, Homo sapiens
ctcaaagttgttctcagccttctcac

SEQ ID NO: 1204 - DNA, 26 bp, Homo sapiens
gcctaagtccagtagtatggtggctg

SEQ ID NO: 1205 - DNA, 24 bp, Homo sapiens
atgtattgtggattgaaagcattt

SEQ ID NO: 1206 - DNA, 26 bp, Homo sapiens
cttggtgaaagggagtgaatctctgc

SEQ ID NO: 1207 - DNA, 24 bp, Homo sapiens
ctcctcccaacttctactcacccc

SEQ ID NO: 1208 - DNA, 24 bp, Homo sapiens
gtgctgtgtgaccttgggatgtcc

SEQ ID NO: 1209 - DNA, 23 bp, Homo sapiens
cctgagcaacaagagcgaaactc

SEQ ID NO: 1210 - DNA, 23 bp, Homo sapiens
tcattctccacctcccaccctgc

SEQ ID NO: 1211 - DNA, 23 bp, Homo sapiens
gctgaagcagtgtggcaacagga

SEQ ID NO: 1212 - DNA, 26 bp, Homo sapiens
ctctctctacaaatcaggttccactg

SEQ ID NO: 1213 - DNA, 26 bp, Homo sapiens
cctggaacttgggcaaactaaactcc

SEQ ID NO: 1214 - DNA, 23 bp, Homo sapiens
ggatggtagtttccaccgtctgg

SEQ ID NO: 1215 - DNA, 26 bp, Homo sapiens
gattcatcatttactgcctccaccag

SEQ ID NO: 1216 - DNA, 26 bp, Homo sapiens
ggtcatcatcgtggacaaggaaagcc

SEQ ID NO: 1217 - DNA, 23 bp, Homo sapiens
gcgttggagaagacctcagccat

SEQ ID NO: 1218 - DNA, 18 bp, Homo sapiens
gtgttaaatatgttgaat

SEQ ID NO: 1219 - DNA, 26 bp, Homo sapiens
gctacatctgggtgaactttagactc

SEQ ID NO: 1220 - DNA, 24 bp, Homo sapiens
gtgttcattacctgatttgattta

SEQ ID NO: 1221 - DNA, 26 bp, Homo sapiens
gggtgctacgagatagggaaaggatg

SEQ ID NO: 1222 - DNA, 26 bp, Homo sapiens
tgggttgactaaaatcccgtaaaagc

SEQ ID NO: 1223 - DNA, 26 bp, Homo sapiens
cctgtgcccagtctccgtcttttatc

SEQ ID NO: 1224 - DNA, 26 bp, Homo sapiens
ttcacttaccctcaccgcactcaacc

SEQ ID NO: 1225 - DNA, 24 bp, Homo sapiens
tcacccagtttctgctgtcaatgc

SEQ ID NO: 1226 - DNA, 24 bp, Homo sapiens
aatgaactatcaggctatgtaaaa

SEQ ID NO: 1227 - DNA, 26 bp, Homo sapiens
gacagcaggacacctcagtgccataa

SEQ ID NO: 1228 - DNA, 24 bp, Homo sapiens
ttagtctcttctttccttgacaaa

SEQ ID NO: 1229 - DNA, 26 bp, Homo sapiens
gcatagggtagttgctccttgagttt

SEQ ID NO: 1230 - DNA, 26 bp, Homo sapiens
cctctggtggcagtcatcaaaatcgc

SEQ ID NO: 1231 - DNA, 26 bp, Homo sapiens
tatggttccagcagatagtttccctg

SEQ ID NO: 1232 - DNA, 24 bp, Homo sapiens
aagtcagaaagccacaagataaat

SEQ ID NO: 1233 - DNA, 26 bp, Homo sapiens
caatcttgtggtatcctatgtcttag

SEQ ID NO: 1234 - DNA, 26 bp, Homo sapiens
ggctaaacccacaccctgtaataacc

SEQ ID NO: 1235 - DNA, 26 bp, Homo sapiens
gtgacaccaacacgggattctttcgc

SEQ ID NO: 1236 - DNA, 26 bp, Homo sapiens
cttcttctccttgcctttcctctgga

SEQ ID NO: 1237 - DNA, 26 bp, Homo sapiens
ccactacaaccaccatcactcgctgt

SEQ ID NO: 1238 - DNA, 26 bp, Homo sapiens
aactaaccaggaaaacgacatagcac

SEQ ID NO: 1239 - DNA, 23 bp, Homo sapiens
gcattccaggtccaagatgtcct

SEQ ID NO: 1240 - DNA, 26 bp, Homo sapiens
cacagcaacaaaagcaacctggtgtc

SEQ ID NO: 1241 - DNA, 26 bp, Homo sapiens
attgactgtcttgggaaaagcactta

SEQ ID NO: 1242 - DNA, 26 bp, Homo sapiens
ttctgagtctggttctccattcaaat

SEQ ID NO: 1243 - DNA, 26 bp, Homo sapiens
cagtggctccaaagtcaaaacaaggt

SEQ ID NO: 1244 - DNA, 26 bp, Homo sapiens
aactcctggctcaaggtgttgctttg

SEQ ID NO: 1245 - DNA, 26 bp, Homo sapiens
ggctccactttctcctattttgaacc

SEQ ID NO: 1246 - DNA, 23 bp, Homo sapiens
tgtcctcccttctcttgctcagc

SEQ ID NO: 1247 - DNA, 25 bp, Homo sapiens
ctgagacaaggcagggcaggtgtta

SEQ ID NO: 1248 - DNA, 24 bp, Homo sapiens
ttagatggatgaaagagatgaaaa

SEQ ID NO: 1249 - DNA, 23 bp, Homo sapiens
gccaagggttcagaaagcccagg

SEQ ID NO: 1250 - DNA, 26 bp, Homo sapiens
caccagcctttgtgttgtcgtccaat

SEQ ID NO: 1251 - DNA, 24 bp, Homo sapiens
acgcaaatgctttcccacagaata

SEQ ID NO: 1252 - DNA, 26 bp, Homo sapiens
ccgcatcagagattcctcaagtttgc

SEQ ID NO: 1253 - DNA, 26 bp, Homo sapiens
gggcagggtatctaaggcaatggttc

SEQ ID NO: 1254 - DNA, 23 bp, Homo sapiens
gaagccagcacttgggagaccac

SEQ ID NO: 1255 - DNA, 24 bp, Homo sapiens
ttctgactctctccctttggtgag

SEQ ID NO: 1256 - DNA, 23 bp, Homo sapiens
tccgaccaacccagaccaacctg

SEQ ID NO: 1257 - DNA, 26 bp, Homo sapiens
atggtggtaaacacagacatctatct

SEQ ID NO: 1258 - DNA, 26 bp, Homo sapiens
ggcttgggaaatcactctaataggtc

SEQ ID NO: 1259 - DNA, 26 bp, Homo sapiens
caaatctctcatctacgccgtttcta

SEQ ID NO: 1260 - DNA, 26 bp, Homo sapiens
ttgaggcaggaagaaaggtttatggc

SEQ ID NO: 1261 - DNA, 24 bp, Homo sapiens
ttttctgcctcagcctcccaagta

SEQ ID NO: 1262 - DNA, 23 bp, Homo sapiens
agagccagtccgagttccaaaac

SEQ ID NO: 1263 - DNA, 26 bp, Homo sapiens
agattctgtccctggcaaccaaacac

SEQ ID NO: 1264 - DNA, 25 bp, Homo sapiens
ggaaaatctaaaagtaatggacaaa

SEQ ID NO: 1265 - DNA, 25 bp, Homo sapiens
cttgcttgttattctacatttctat

SEQ ID NO: 1266 - DNA, 26 bp, Homo sapiens
attcggagttgagagtcctgggtctt

SEQ ID NO: 1267 - DNA, 23 bp, Homo sapiens
ctccccacccttctggaaaagag

SEQ ID NO: 1268 - DNA, 26 bp, Homo sapiens
ggttggaagccttacgcagtctcaag

SEQ ID NO: 1269 - DNA, 26 bp, Homo sapiens
ctctcttggtgtttggaaatctgtgc

SEQ ID NO: 1270 - DNA, 23 bp, Homo sapiens
aaaactgaaaggacgaacccagc

SEQ ID NO: 1271 - DNA, 23 bp, Homo sapiens
cagcccaggaccaccagcgaagt

SEQ ID NO: 1272 - DNA, 24 bp, Homo sapiens
gaccagaccaaaccaaaccaacat

SEQ ID NO: 1273 - DNA, 23 bp, Homo sapiens
gaccctgagccacagcaaagcct

SEQ ID NO: 1274 - DNA, 26 bp, Homo sapiens
ctaagtccagtagtatggtggctgtg

SEQ ID NO: 1275 - DNA, 26 bp, Homo sapiens
gctatggagtgtctctttgggtctca

SEQ ID NO: 1276 - DNA, 23 bp, Homo sapiens
gcctgtcactccaatctgtggtg

SEQ ID NO: 1277 - DNA, 26 bp, Homo sapiens
aggctgtgcttggctggttgtgtaac

SEQ ID NO: 1278 - DNA, 23 bp, Homo sapiens
ggaaagtcccaggctccaggaag

SEQ ID NO: 1279 - DNA, 25 bp, Homo sapiens
gtccctgctctcaaagaacttagga

SEQ ID NO: 1280 - DNA, 24 bp, Homo sapiens
ctggaagtgaccttagagattatc

SEQ ID NO: 1281 - DNA, 26 bp, Homo sapiens
tcctcagatgatgtttcggcatttgc

SEQ ID NO: 1282 - DNA, 26 bp, Homo sapiens
ggtgactgacagccaaatccaatggg

SEQ ID NO: 1283 - DNA, 24 bp, Homo sapiens
tgggctccaaacacccgaggtcat

SEQ ID NO: 1284 - DNA, 26 bp, Homo sapiens
ctcccagaaaccagacccacaaagag

SEQ ID NO: 1285 - DNA, 26 bp, Homo sapiens
atcaagaaaactactcacaggacagc

SEQ ID NO: 1286 - DNA, 26 bp, Homo sapiens
caagtcctcatctgtagagtctggat

SEQ ID NO: 1287 - DNA, 24 bp, Homo sapiens
aaagagacagaaacagagaggtta

SEQ ID NO: 1288 - DNA, 26 bp, Homo sapiens
gcagccattacaaaatcaccttcagg

SEQ ID NO: 1289 - DNA, 23 bp, Homo sapiens
gccaggaaaagcctcagagtcac

SEQ ID NO: 1290 - DNA, 23 bp, Homo sapiens
gtgctcgtctcaccatcttcctg

SEQ ID NO: 1291 - DNA, 24 bp, Homo sapiens
catcaggcttctgggaatggaaat

SEQ ID NO: 1292 - DNA, 23 bp, Homo sapiens
aagacagggttggcaaaggcagc

SEQ ID NO: 1293 - DNA, 23 bp, Homo sapiens
tctccactcactcccacccttgg

SEQ ID NO: 1294 - DNA, 26 bp, Homo sapiens
gctttccttcttccttatgatgacag

SEQ ID NO: 1295 - DNA, 26 bp, Homo sapiens
ttggataagaacgagcaggtattggc

SEQ ID NO: 1296 - DNA, 24 bp, Homo sapiens
gcaaagacctactcccacctcctc

SEQ ID NO: 1297 - DNA, 26 bp, Homo sapiens
cccaaagtttcggttcattagatttc

SEQ ID NO: 1298 - DNA, 26 bp, Homo sapiens
aaggagagggaaaacagtgggcaata

SEQ ID NO: 1299 - DNA, 23 bp, Homo sapiens
aaacgggtctccacggcaccaag

SEQ ID NO: 1300 - DNA, 22 bp, Homo sapiens
tggcagacgcctgtaatcccag

SEQ ID NO: 1301 - DNA, 26 bp, Homo sapiens
gattgaacgccatctggtgtgactgg

SEQ ID NO: 1302 - DNA, 24 bp, Homo sapiens
tcttatttcccaaggctcaaaagc

SEQ ID NO: 1303 - DNA, 26 bp, Homo sapiens
gtggttcaaggtaggaagagaaaagc

SEQ ID NO: 1304 - DNA, 25 bp, Homo sapiens
taaccagggtagccttgatgccagc

SEQ ID NO: 1305 - DNA, 26 bp, Homo sapiens
gccacactggaacataccaagtaaac

SEQ ID NO: 1306 - DNA, 26 bp, Homo sapiens
ttgcccgctatctttacttcagttgc

SEQ ID NO: 1307 - DNA, 24 bp, Homo sapiens
atcagtgttttctcctctcaaata

SEQ ID NO: 1308 - DNA, 24 bp, Homo sapiens
tacagtatttgagtcacaggctgc

SEQ ID NO: 1309 - DNA, 26 bp, Homo sapiens
atcacctcctatgaagacctacctct

SEQ ID NO: 1310 - DNA, 25 bp, Homo sapiens
gaaaatgaatccaagaaaactctat

SEQ ID NO: 1311 - DNA, 26 bp, Homo sapiens
acacggtccctgactcaagatggttg

SEQ ID NO: 1312 - DNA, 26 bp, Homo sapiens
gcacaaacacgatgacacttcacaga

SEQ ID NO: 1313 - DNA, 26 bp, Homo sapiens
actgtctgaagcaatcggttccccag

SEQ ID NO: 1314 - DNA, 24 bp, Homo sapiens
aaagtgctgggattacaggcgtga

SEQ ID NO: 1315 - DNA, 26 bp, Homo sapiens
ttctgtggaggacctgggaaatactc

SEQ ID NO: 1316 - DNA, 26 bp, Homo sapiens
ctctaagtaaatcctggtcattcccc

SEQ ID NO: 1317 - DNA, 26 bp, Homo sapiens
tgttatcaggacagcagttagcagga

SEQ ID NO: 1318 - DNA, 26 bp, Homo sapiens
ggagaaaagacaaaccagggaaaggg

SEQ ID NO: 1319 - DNA, 26 bp, Homo sapiens
tttgaaatggagacatagcccaaggc

SEQ ID NO: 1320 - DNA, 26 bp, Homo sapiens
cctttgctgggtattgactgggagga

SEQ ID NO: 1321 - DNA, 26 bp, Homo sapiens
gtggtgtgagttcaggagggtttagg

SEQ ID NO: 1322 - DNA, 26 bp, Homo sapiens
ccaccgatttattgccctgtaggaca

SEQ ID NO: 1323 - DNA, 26 bp, Homo sapiens
gggactgagtgacacaaggaccattt

SEQ ID NO: 1324 - DNA, 26 bp, Homo sapiens
atgagcctggaacatctggtgatacc

SEQ ID NO: 1325 - DNA, 26 bp, Homo sapiens
gcagccaatcttgagaactgatgccc

SEQ ID NO: 1326 - DNA, 26 bp, Homo sapiens
tgggagcaggagtggaggaatagatt

SEQ ID NO: 1327 - DNA, 26 bp, Homo sapiens
gcggtcatcagtgctgtcatttcctg

SEQ ID NO: 1328 - DNA, 60 bp, Homo sapiens
aatgttacttattatgattattagataatcgaaaaggggccctttagaacccaaggaaaa

SEQ ID NO: 1329 - DNA, 60 bp, Homo sapiens
attcttttaaacctaaaattagactgcttcgaacttttgttcatatcgttattcccccaa

SEQ ID NO: 1330 - DNA, 60 bp, Homo sapiens
agcaatatgtttttaagatttatcctcatcgatgaatcttacaaaagaaaatacagagtt

SEQ ID NO: 1331 - DNA, 60 bp, Homo sapiens
tatttgctaaagagataattcagtgttttcgaaaaaaaatggcctcctagattttgttta

SEQ ID NO: 1332 - DNA, 60 bp, Homo sapiens
tataataccagtattttctcaaatagaatcgatttttttcacatcaacgttacaccaaaa

SEQ ID NO: 1333 - DNA, 60 bp, Homo sapiens
gaaatgagccaataattttttttttttttcgattagcaataatgataataacaagggtga

SEQ ID NO: 1334 - DNA, 60 bp, Homo sapiens
gggctaactttatattttataaatgtagtcgatcttcgtttgaaacacaaggtctatcac

SEQ ID NO: 1335 - DNA, 60 bp, Homo sapiens
ctataaagtgatgatttctgagatctattcgagtgacttagtgatcctgggtatacaccc

SEQ ID NO: 1336 - DNA, 60 bp, Homo sapiens
atggtaagttttgggaattcaaagaacctcgattctcagctatatccttaatactggaag

SEQ ID NO: 1337 - DNA, 60 bp, Homo sapiens
gaattatcaaattatattccaggtttgttcgatcataaagtttgtaggtttgtagagctg

SEQ ID NO: 1338 - DNA, 60 bp, Homo sapiens
aggacagagtttcagagtaaaatttaattcgaaaaacaaaaataataaatgcaatattga

SEQ ID NO: 1339 - DNA, 60 bp, Homo sapiens
attcacataaaaaacttttttgtgaacatcgagtaagttcaaaacccaacaaggtgaata

SEQ ID NO: 1340 - DNA, 60 bp, Homo sapiens
ttgtctttgctgaggaatctctcataattcgattctgagtgaggctaaaagccactggaa

SEQ ID NO: 1341 - DNA, 60 bp, Homo sapiens
aaatttctgtaataaaatgggagaaatgtcgagttgtttccaataattttaaaagatggc

SEQ ID NO: 1342 - DNA, 60 bp, Homo sapiens
tgctcttttaggatagcttgaagtaatttcgaaagaaagagaagtgaaagtctctctttg

SEQ ID NO: 1343 - DNA, 60 bp, Homo sapiens
gcaattcatatagtctaaaaaattttaatcgattgattgtagctcaaactgtagaaatag

SEQ ID NO: 1344 - DNA, 60 bp, Homo sapiens
atagcctaaaataatgttttcagtattgtcgaatctttccaataaatttgatatgtttac

SEQ ID NO: 1345 - DNA, 60 bp, Homo sapiens
tcttttctgtggttaaattttataaggatcgattcagctggggaaaaatgaaaataacaa

SEQ ID NO: 1346 - DNA, 60 bp, Homo sapiens
gtagctgattcagtggtgtttataaagatcgatagttgctttgttcttcttgtctatggt

SEQ ID NO: 1347 - DNA, 60 bp, Homo sapiens
attcttttaaacctaaaattagactgcttcgagagcctcatagatctctctgaggtacag

SEQ ID NO: 1348 - DNA, 60 bp, Homo sapiens
attcttttaaacctaaaattagactgcttcgacaaatttatgatgcctacatcatgaagg

SEQ ID NO: 1349 - DNA, 60 bp, Homo sapiens
taaacaaaatctaggaggccattttttttcgaaatataatgtaggaatattaaagaaaat

SEQ ID NO: 1350 - DNA, 60 bp, Homo sapiens
ggaactattacttaaactcttaaactcttcgacatgattaaggtatttccctttttctct

SEQ ID NO: 1351 - DNA, 60 bp, Homo sapiens
ttatattggaaatctgtttcaacaataatcgattcagcataaaataaatgcaaatgaaag

SEQ ID NO: 1352 - DNA, 60 bp, Homo sapiens
aaccggttttgtcacaaacattgaaaaatcgaagaatgaatggtgatgaggagatgttta

SEQ ID NO: 1353 - DNA, 60 bp, Homo sapiens
tcttttcttccttttctctttcttcctttcgactattttattttttgtagagacgagatc

SEQ ID NO: 1354 - DNA, 60 bp, Homo sapiens
ttggaaaaggtaaattgtgttttgtaaatcgaacatcaggtcagaattccaaaggggcgt

SEQ ID NO: 1355 - DNA, 60 bp, Homo sapiens
gattcagaatgtctagtattttattcaatcgattgatttttccaaaatcactgcttcaaa

SEQ ID NO: 1356 - DNA, 60 bp, Homo sapiens
accatatggtgactttatctttactccttcgaggggaactattaaatatgagttagggtt

SEQ ID NO: 1357 - DNA, 60 bp, Homo sapiens
aaccggttttgtcacaaacattgaaaaatcgattttcattctcaatgaatgttgatcatc

SEQ ID NO: 1358 - DNA, 60 bp, Homo sapiens
agactggatccgtcactttagaacagactcgagattatcagtaagctctagggaaactag

SEQ ID NO: 1359 - DNA, 60 bp, Homo sapiens
cttccagtattaaggatatagctgagaatcgaagtctcagctgagggattacttcttcag

SEQ ID NO: 1360 - DNA, 60 bp, Homo sapiens
tcattttatctgtcgtatcaagagcaattcgactgagatgtctgaaagcctaaaatataa

SEQ ID NO: 1361 - DNA, 60 bp, Homo sapiens
tgacacagtgtagatgtttaatatatattcgagaatgtatatggaaaggcagaggagcta

SEQ ID NO: 1362 - DNA, 60 bp, Homo sapiens
ttaattcttccatatctaagcctctttgtcgaagaatatctctactcggctgtaaataat

SEQ ID NO: 1363 - DNA, 60 bp, Homo sapiens
caccattgcaaagttgaaaaatcgtatgtcgagacatacttatgagcacctactatgtgc

SEQ ID NO: 1364 - DNA, 60 bp, Homo sapiens
gcatttttatgaaattaaatgtccgtattcgaaataaagcacaagtgactcctttcctca

SEQ ID NO: 1365 - DNA, 60 bp, Homo sapiens
aattccatctcaattataattttttaactcgatctgcgattgtttgaatctgcagatgca

SEQ ID NO: 1366 - DNA, 60 bp, Homo sapiens
gataatcaaaaaacatttgttgaatagatcgagtccatgtccagttgttaattcaatgtg

SEQ ID NO: 1367 - DNA, 60 bp, Homo sapiens
gctagaataattactatagtcatgtttttcgaaattagttactttaagaaaccccatata

SEQ ID NO: 1368 - DNA, 60 bp, Homo sapiens
tctgtctttttctcaagcaggaaacatttcgagtgaggaattaaattcatagaggtaacc

SEQ ID NO: 1369 - DNA, 60 bp, Homo sapiens
agtttttaatgtcaaatatgatatacagtcgaaacagttatttactttcaactctctcat

SEQ ID NO: 1370 - DNA, 60 bp, Homo sapiens
ttcgtgtttattgttttccataagaaattcgattgcatctaacctttggatctcattcaa

SEQ ID NO: 1371 - DNA, 60 bp, Homo sapiens
aattcttccctaaggatatttattaacttcgatttagaagttacttccttgtggccctgg

SEQ ID NO: 1372 - DNA, 60 bp, Homo sapiens
gttgactcttagaacaacggaaaaactatcgaaaatgggttctgtttcaaatacatggaa

SEQ ID NO: 1373 - DNA, 60 bp, Homo sapiens
tttaaactgataagaacagatattaccctcgaattattgcaacaacctgttaatctggtg

SEQ ID NO: 1374 - DNA, 60 bp, Homo sapiens
gagattttcttaagacggtaattcttaatcgagttactcaaagaccaaggggcttaaaaa

SEQ ID NO: 1375 - DNA, 60 bp, Homo sapiens
cttaaagctgtctaaattttatcttagttcgaggccctttcaggactcttttcctgggga

SEQ ID NO: 1376 - DNA, 60 bp, Homo sapiens
attgtgacaatcacattttaagtactcttcgaaagagaatgatctgaacattttaggatg

SEQ ID NO: 1377 - DNA, 60 bp, Homo sapiens
tgttaattttcagtaggtttcctaagtgtcgagcttccattttctctctgacttcacgtt

SEQ ID NO: 1378 - DNA, 60 bp, Homo sapiens
tgtcaattttcaatataattcatacagttcgactttcactacgactctgagggaggttct

SEQ ID NO: 1379 - DNA, 60 bp, Homo sapiens
catatgagaaagtggaaaagatttaaaatcgaatgaaaaatgaaatcatgctatgccttt

SEQ ID NO: 1380 - DNA, 60 bp, Homo sapiens
attactagtttattatacagtttggacctcgagggacagcagtaaatttacaacccaaag

SEQ ID NO: 1381 - DNA, 60 bp, Homo sapiens
aactcttccataaagatttatcaaaaattcgattttattcattttattttgatgttccca

SEQ ID NO: 1382 - DNA, 60 bp, Homo sapiens
gtctggcattgtggaatactcaattacatcgaaaaaaaaaagaaaaagaaaaaagaaaaa

SEQ ID NO: 1383 - DNA, 60 bp, Homo sapiens
tgtttatctcaaaagaagctcagaaaactcgatttttaagagtcaaagattttgatttaa

SEQ ID NO: 1384 - DNA, 60 bp, Homo sapiens
ctcatctttgttaattcagatctatttttcgaaagtatttagcaggtcatgaaacacaaa

SEQ ID NO: 1385 - DNA, 60 bp, Homo sapiens
tacatatagcaagatagaagaaataacttcgaaaagattttgatgttttgtttataaaga

SEQ ID NO: 1386 - DNA, 60 bp, Homo sapiens
gtttctttttaattcttcataatacccttcgaccttggttctctccctttctagggcttg

SEQ ID NO: 1387 - DNA, 60 bp, Homo sapiens
tctcaaatatacttataaacaaaagggttcgatgcataaatatgcatctataatatgttt

SEQ ID NO: 1388 - DNA, 60 bp, Homo sapiens
gtatatatatatatatatatatatatgatcgaatggcagctctactttcatttccttaag

SEQ ID NO: 1389 - DNA, 60 bp, Homo sapiens
gagtatttaagataggtgcctattatcctcgattatctctttatgacgtttattagacaa

SEQ ID NO: 1390 - DNA, 60 bp, Homo sapiens
aaaaaacctttataaagagaagagaaaatcgatttcattcttttaagctttcccaacact

SEQ ID NO: 1391 - DNA, 60 bp, Homo sapiens
tatttatttttatcataagccatgttgttcgattattgttattattattctttgagacag

SEQ ID NO: 1392 - DNA, 60 bp, Homo sapiens
atttgctgcccctacagggcagcaggtttcgactattttctagatttcaacttgtctttt

SEQ ID NO: 1393 - DNA, 60 bp, Homo sapiens
gcttactcagaacttaaaaatttcataatcgaatactcttctctgatgctgaattttata

SEQ ID NO: 1394 - DNA, 60 bp, Homo sapiens
cctgagttggtgaattttgtatgctttctcgatgtttctaaaaactcattatttctttag

SEQ ID NO: 1395 - DNA, 60 bp, Homo sapiens
accaagcagaactgtatttaaaacaaattcgaagaaaaagtagatttttattactcaaaa

SEQ ID NO: 1396 - DNA, 60 bp, Homo sapiens
tcttcaataacagtatttctaaaatgtttcgaatgtcatcaatgtatgtattaagtgagt

SEQ ID NO: 1397 - DNA, 60 bp, Homo sapiens
tcacactaatttgttaaatgcaagtttatcgatttcaccaagtttgcaaaagattctgtg

SEQ ID NO: 1398 - DNA, 60 bp, Homo sapiens
tttggatgtgtcataatctacttaaaattcgatacttatctttacaaaacgcaagaataa

SEQ ID NO: 1399 - DNA, 60 bp, Homo sapiens; identical to SEQ ID NO: 50

SEQ ID NO: 1400 - DNA, 60 bp, Homo sapiens
ttttcactcaactttcactggagatttatcgacaaaataaatgtagtagaatttctttga

SEQ ID NO: 1401 - DNA, 60 bp, Homo sapiens
ttcacacaagatagaaaatcattaaaactcgaggagaaccttctaataagagatgatcaa

SEQ ID NO: 1402 - DNA, 60 bp, Homo sapiens
ataatgtgtaattcacctttatgtaccttcgaagttagtgtcagtggtcaacttctcccg

SEQ ID NO: 1403 - DNA, 60 bp, Homo sapiens
aattcttcatccttccttacatgtgttatcgaaaagacaggtatttgcatgatttttttt

SEQ ID NO: 1404 - DNA, 60 bp, Homo sapiens
ttccttcttaatcaattcaagagcatgttcgatttataacaaaaataaacactgtagaaa

SEQ ID NO: 1405 - DNA, 60 bp, Homo sapiens
ttgtaaagtgctatagataataggattttcgatagagttaaatacattttggttggatgg

SEQ ID NO: 1406 - DNA, 60 bp, Homo sapiens
tttaaactgataagaacagatattaccctcgaaatgtagtaagtaaaaccataaaacttt

SEQ ID NO: 1407 - DNA, 60 bp, Homo sapiens
catttttaaaaaactccacttatcacattcgaatattttccgccgacaaggccttttggc

SEQ ID NO: 1408 - DNA, 60 bp, Homo sapiens
gtaaaaacaaagcaaattcttcaaaatttcgaatgaataaaaaattcataaaaataaggc

SEQ ID NO: 1409 - DNA, 60 bp, Homo sapiens
aaagtcatacaactactatgtaagatattcgaatttgtgcttgttgggaaaatagtaatt

SEQ ID NO: 1410 - DNA, 23 bp, Homo sapiens
ggcaccacaccacaagcactgtt

SEQ ID NO: 1411 - DNA, 25 bp, Homo sapiens
atgtgctaatctggaagactctgtc

SEQ ID NO: 1412 - DNA, 26 bp, Homo sapiens
ggtatcctgtgaaacttgcttcctta

SEQ ID NO: 1413 - DNA, 24 bp, Homo sapiens
ttttgtgtcatctgtggtttgtat

SEQ ID NO: 1414 - DNA, 23 bp, Homo sapiens
ctccaactgttctcctgagccgc

SEQ ID NO: 1415 - DNA, 26 bp, Homo sapiens
cttttgtgctcccaagaatactatca

SEQ ID NO: 1416 - DNA, 26 bp, Homo sapiens
gaagtccattcttgggatgaaacaaa

SEQ ID NO: 1417 - DNA, 25 bp, Homo sapiens
accaaagtctcctccagggcatctt

SEQ ID NO: 1418 - DNA, 24 bp, Homo sapiens
aggcttccttgttgtgttcataat

SEQ ID NO: 1419 - DNA, 24 bp, Homo sapiens
aggaaggaaagatgtctaccaaat

SEQ ID NO: 1420 - DNA, 26 bp, Homo sapiens
cgtgacgaactgaagcagaccctttc

SEQ ID NO: 1421 - DNA, 23 bp, Homo sapiens
caccatcatttcccgcccttgtc

SEQ ID NO: 1422 - DNA, 24 bp, Homo sapiens
gctctgaaaacaactaacggtgta

SEQ ID NO: 1423 - DNA, 24 bp, Homo sapiens
tcttgagatgaaatgcctgtttgc

SEQ ID NO: 1424 - DNA, 26 bp, Homo sapiens
ctcaggcagaagcagaacttggctct

SEQ ID NO: 1425 - DNA, 24 bp, Homo sapiens
tccaggtatctacttttcttctat

SEQ ID NO: 1426 - DNA, 26 bp, Homo sapiens
gggctaagataggtgaaacgaggctg

SEQ ID NO: 1427 - DNA, 26 bp, Homo sapiens
gcttagatgtggctttgtcttttctc

SEQ ID NO: 1428 - DNA, 26 bp, Homo sapiens
cctccttttgcctccgattcctcatc

SEQ ID NO: 1429 - DNA, 23 bp, Homo sapiens
gtgctaatctggaagactctgtc

SEQ ID NO: 1430 - DNA, 24 bp, Homo sapiens
tgtgctaatctggaagactctgtc

SEQ ID NO: 1431 - DNA, 23 bp, Homo sapiens
ccagccttatgactttcagtgtg

SEQ ID NO: 1432 - DNA, 26 bp, Homo sapiens
gtgcctcagttttcctcatccctaag

SEQ ID NO: 1433 - DNA, 24 bp, Homo sapiens
tggcagtcatcaaaatcgcttcta

SEQ ID NO: 1434 - DNA, 23 bp, Homo sapiens
gctttgcttcacaggcttgccca

SEQ ID NO: 1435 - DNA, 23 bp, Homo sapiens
tgccacccagtaggtctcagtct

SEQ ID NO: 1436 - DNA, 23 bp, Homo sapiens
ggttgctggctggagtcttctga

SEQ ID NO: 1437 - DNA, 24 bp, Homo sapiens
atgtgagtgttccttgtagattac

SEQ ID NO: 1438 - DNA, 26 bp, Homo sapiens
gaagagaccttatccttttgaactac

SEQ ID NO: 1439 - DNA, 26 bp, Homo sapiens
ccaccgatttattgccctgtaggaca

SEQ ID NO: 1440 - DNA, 26 bp, Homo sapiens
actctggctccgtttcttccctgact

SEQ ID NO: 1441 - DNA, 26 bp, Homo sapiens
cattcttccctcagccatccatttgg

SEQ ID NO: 1442 - DNA, 26 bp, Homo sapiens
gccatagagccttccctgaacagaga

SEQ ID NO: 1443 - DNA, 24 bp, Homo sapiens
aatactcctcagagaaccaataat

SEQ ID NO: 1444 - DNA, 26 bp, Homo sapiens
cccttcccttggcttttgagtctgaa

SEQ ID NO: 1445 - DNA, 26 bp, Homo sapiens
tctacaagagagtgtcccaccacata

SEQ ID NO: 1446 - DNA, 23 bp, Homo sapiens
ccagccctctgttctgctaccat

SEQ ID NO: 1447 - DNA, 26 bp, Homo sapiens
tgagaggttatgacttttccgaggtc

SEQ ID NO: 1448 - DNA, 26 bp, Homo sapiens
ggctaaaatacaaatcccacaagaag

SEQ ID NO: 1449 - DNA, 26 bp, Homo sapiens
ggattgaaggtctctattatcagtca

SEQ ID NO: 1450 - DNA, 26 bp, Homo sapiens
agtaatgccagcccctgaacccatct

SEQ ID NO: 1451 - DNA, 26 bp, Homo sapiens
ggcaatggtcaagggcacgaacacaa

SEQ ID NO: 1452 - DNA, 26 bp, Homo sapiens
gagaatgtcaccaggattgcccaagc

SEQ ID NO: 1453 - DNA, 23 bp, Homo sapiens
ggcacacagaagacgctcagcaa

SEQ ID NO: 1454 - DNA, 24 bp, Homo sapiens
gtgtttcatttccttatcatttca

SEQ ID NO: 1455 - DNA, 26 bp, Homo sapiens
acacaaagtcaggaagggtgcgtgaa

SEQ ID NO: 1456 - DNA, 26 bp, Homo sapiens
caggtattgccagccacagcgtttga

SEQ ID NO: 1457 - DNA, 23 bp, Homo sapiens
agatgtgtgtgggctctcgggct

SEQ ID NO: 1458 - DNA, 26 bp, Homo sapiens
gtgtctcggagtctctttgaaccagc

SEQ ID NO: 1459 - DNA, 25 bp, Homo sapiens
gcataaaggtaacttcctcctgacg

SEQ ID NO: 1460 - DNA, 24 bp, Homo sapiens
ccagtagtggaggctttgcgtttt

SEQ ID NO: 1461 - DNA, 23 bp, Homo sapiens
gctacagcagtgtttagagggaa

SEQ ID NO: 1462 - DNA, 26 bp, Homo sapiens
acccaaacagcattacaacagcagtt

SEQ ID NO: 1463 - DNA, 23 bp, Homo sapiens
tcctgatgcttccttcgtgcccc

SEQ ID NO: 1464 - DNA, 26 bp, Homo sapiens
gccacaaagtaaagcaagaagtaggg

SEQ ID NO: 1465 - DNA, 26 bp, Homo sapiens
ggaaatggtggcgggaaggagaaatg

SEQ ID NO: 1466 - DNA, 26 bp, Homo sapiens
cctcccagtcatttccctctcaccat

SEQ ID NO: 1467 - DNA, 24 bp, Homo sapiens
tactgctgaaaacaatcctatggg

SEQ ID NO: 1468 - DNA, 24 bp, Homo sapiens
ccctcccactcaccaaacaacagg

SEQ ID NO: 1469 - DNA, 26 bp, Homo sapiens
attcactttcactctcaggtgtgtcc

SEQ ID NO: 1470 - DNA, 23 bp, Homo sapiens
cttgacctcttcctctgctgaat

SEQ ID NO: 1471 - DNA, 26 bp, Homo sapiens
gactctttgtaagcacagaactcaac

SEQ ID NO: 1472 - DNA, 26 bp, Homo sapiens
aagggcaggagaggaatagggcaaag

SEQ ID NO: 1473 - DNA, 23 bp, Homo sapiens
taagcctccacaagccccatcat

SEQ ID NO: 1474 - DNA, 25 bp, Homo sapiens
aaaagtgggacaagaaggaggcagc

SEQ ID NO: 1475 - DNA, 26 bp, Homo sapiens
ctaccatagcccttttatcaatccag

SEQ ID NO: 1476 - DNA, 24 bp, Homo sapiens
tgcttcctaaaacacggcaaagtg

SEQ ID NO: 1477 - DNA, 24 bp, Homo sapiens
aaagggtcaagaaatcaagatagc

SEQ ID NO: 1478 - DNA, 23 bp, Homo sapiens
gtgcctccttatcccctcagtcc

SEQ ID NO: 1479 - DNA, 24 bp, Homo sapiens
ctaagtgtagaaataaatgcgaaa

SEQ ID NO: 1480 - DNA, 24 bp, Homo sapiens
gacattggcagaggtaaataaata

SEQ ID NO: 1481 - DNA, 26 bp, Homo sapiens
ctgttctcagcaatggaatctcaggt

SEQ ID NO: 1482 - DNA, 24 bp, Homo sapiens
gtagcaaacccacttccctcctgc

SEQ ID NO: 1483 - DNA, 26 bp, Homo sapiens
gctgtctcccctgtattgttctgact

SEQ ID NO: 1484 - DNA, 26 bp, Homo sapiens
cttgcttctgggtgcctttgctcttg

SEQ ID NO: 1485 - DNA, 26 bp, Homo sapiens
ttaggtcctggctgaagcagaggtat

SEQ ID NO: 1486 - DNA, 23 bp, Homo sapiens
cagaaggcagcccacccactgat

SEQ ID NO: 1487 - DNA, 26 bp, Homo sapiens
aaactcctgacctctcacctgccttg

SEQ ID NO: 1488 - DNA, 24 bp, Homo sapiens
agaatgggtcttactttgaaaata

SEQ ID NO: 1489 - DNA, 24 bp, Homo sapiens
atcataatgtggtgtggcaagtgc

SEQ ID NO: 1490 - DNA, 26 bp, Homo sapiens
ggaactacagtgtcttctacagggac

SEQ ID NO: 1491 - DNA, 26 bp, Homo sapiens
gaaaaccagtcaatcctcaagtgtgc

SEQ ID NO: 1492 - DNA, 23 bp, Homo sapiens
ctggtgaggaaagagagggtggg

SEQ ID NO: 1493 - DNA, 26 bp, Homo sapiens
gcgggtttgtgtcagaagggtgtaaa

SEQ ID NO: 1494 - DNA, 26 bp, Homo sapiens
tgaaatgagcaggtgggagtaggtgg

SEQ ID NO: 1495 - DNA, 24 bp, Homo sapiens
tgttcctatttctctcctatttta

SEQ ID NO: 1496 - DNA, 23 bp, Homo sapiens
gcagcaggtcctcagatgatgtc

SEQ ID NO: 1497 - DNA, 26 bp, Homo sapiens
ctgtgtgaccttgggcaacttgtgta

SEQ ID NO: 1498 - DNA, 23 bp, Homo sapiens
ggctctaagattgaggctgtgat

SEQ ID NO: 1499 - DNA, 26 bp, Homo sapiens
gagtggagatggtagaagagtctgtg

SEQ ID NO: 1500 - DNA, 24 bp, Homo sapiens
ttcttccctcagccatccatttgg

SEQ ID NO: 1501 - DNA, 24 bp, Homo sapiens
aagttagagttcagttggagatgc

SEQ ID NO: 1502 - DNA, 26 bp, Homo sapiens
catcctttatcttccctaccccatca

SEQ ID NO: 1503 - DNA, 24 bp, Homo sapiens
cccactccagtttgtccaggatgc

SEQ ID NO: 1504 - DNA, 24 bp, Homo sapiens
acttctaccctcatccctctccat

SEQ ID NO: 1505 - DNA, 24 bp, Homo sapiens
ggttcaaggtaggaagagaaaagc

SEQ ID NO: 1506 - DNA, 26 bp, Homo sapiens
ccactttctctgataaggcaaacgct

SEQ ID NO: 1507 - DNA, 24 bp, Homo sapiens
tgttcctcactattccaaaatgaa

SEQ ID NO: 1508 - DNA, 26 bp, Homo sapiens
caaagtagtagggcaaggcaaatgaa

SEQ ID NO: 1509 - DNA, 26 bp, Homo sapiens
gacctggctactcttgaaacacccac

SEQ ID NO: 1510 - DNA, 26 bp, Homo sapiens
cctgagaggcagcaataactactgtt

SEQ ID NO: 1511 - DNA, 26 bp, Homo sapiens
tctaagaatccattgcgtgtaaaagc

SEQ ID NO: 1512 - DNA, 24 bp, Homo sapiens
aagtaacagagtaagaagaaatac

SEQ ID NO: 1513 - DNA, 26 bp, Homo sapiens
gttatgaatgatgtttgtccctcaac

SEQ ID NO: 1514 - DNA, 23 bp, Homo sapiens
gggaatgtatgctgttctcagag

SEQ ID NO: 1515 - DNA, 24 bp, Homo sapiens
cagacaaagcaaaagatttcctat

SEQ ID NO: 1516 - DNA, 24 bp, Homo sapiens
gctccaggtctcttcccaagtgac

SEQ ID NO: 1517 - DNA, 23 bp, Homo sapiens
gagaccaggaactcaggaccagc

SEQ ID NO: 1518 - DNA, 23 bp, Homo sapiens
ccaaccaaatgggaggcaacgcc

SEQ ID NO: 1519 - DNA, 24 bp, Homo sapiens
aggtctcaagcaagggagcaacat

SEQ ID NO: 1520 - DNA, 25 bp, Homo sapiens
gagtttcaagtgccctactggctga

SEQ ID NO: 1521 - DNA, 26 bp, Homo sapiens
tggaaaacacagtcccacctctcaga

SEQ ID NO: 1522 - DNA, 26 bp, Homo sapiens
aatactggcaagaacccatctactgc

SEQ ID NO: 1523 - DNA, 26 bp, Homo sapiens
gccttttattctgtgtgtggctaagc

SEQ ID NO: 1524 - DNA, 26 bp, Homo sapiens
caagcactgtccaataggaagcataa

SEQ ID NO: 1525 - DNA, 24 bp, Homo sapiens
tctgccaacaccacatcatcttga

SEQ ID NO: 1526 - DNA, 26 bp, Homo sapiens
gttctggtttccacctgcttgacttc

SEQ ID NO: 1527 - DNA, 26 bp, Homo sapiens
attgtatctttggtgccagccccgtg

SEQ ID NO: 1528 - DNA, 23 bp, Homo sapiens
gactgactcaccacccaagcacg

SEQ ID NO: 1529 - DNA, 26 bp, Homo sapiens
gaagacatacacagtaagccctctgc

SEQ ID NO: 1530 - DNA, 26 bp, Homo sapiens
tactgggaagttgccttagtccaaat

SEQ ID NO: 1531 - DNA, 24 bp, Homo sapiens
ctattgggcttagagtgtctgtct

SEQ ID NO: 1532 - DNA, 26 bp, Homo sapiens
cctgaggatgtgaatgctgtagtgat

SEQ ID NO: 1533 - DNA, 26 bp, Homo sapiens
acagtttccttggagttgtggagaca

SEQ ID NO: 1534 - DNA, 26 bp, Homo sapiens
cattccagcattggttggcatttgaa

SEQ ID NO: 1535 - DNA, 23 bp, Homo sapiens
cccattcaccctcccttgctgga

SEQ ID NO: 1536 - DNA, 24 bp, Homo sapiens
tctccagttgttagtgtttcaata

SEQ ID NO: 1537 - DNA, 26 bp, Homo sapiens
gattgtatgatttgctgggttgattg

SEQ ID NO: 1538 - DNA, 26 bp, Homo sapiens
gaatggtggaagttttcaggagcaga

SEQ ID NO: 1539 - DNA, 23 bp, Homo sapiens
gtcaccgtccccagcaagaaaga

SEQ ID NO: 1540 - DNA, 26 bp, Homo sapiens
ccgacttacggtgtccattattatgc

SEQ ID NO: 1541 - DNA, 26 bp, Homo sapiens
gtgagtgtgggaaagagtgggaaacg

SEQ ID NO: 1542 - DNA, 26 bp, Homo sapiens
gcacagttgggttattgccattttgg

SEQ ID NO: 1543 - DNA, 23 bp, Homo sapiens
gatgctgaatgaccagtgtgttc

SEQ ID NO: 1544 - DNA, 26 bp, Homo sapiens
caggtgggagagtttcttagtgggca

SEQ ID NO: 1545 - DNA, 26 bp, Homo sapiens
gattcaatgctgtatctacttgctga

SEQ ID NO: 1546 - DNA, 26 bp, Homo sapiens
cacctggagtctggctaccgaaatca

SEQ ID NO: 1547 - DNA, 26 bp, Homo sapiens
tcatcatcgtggacaaggaaagccta

SEQ ID NO: 1548 - DNA, 26 bp, Homo sapiens
cccacactccaaaatgagaaaacctc

SEQ ID NO: 1549 - DNA, 24 bp, Homo sapiens
cttcattggtccctccattgacat

SEQ ID NO: 1550 - DNA, 23 bp, Homo sapiens
gaacctattcccagtgatgcggc

SEQ ID NO: 1551 - DNA, 26 bp, Homo sapiens
agcaacctcaaccgagaatcacccag

SEQ ID NO: 1552 - DNA, 25 bp, Homo sapiens
ctgctggtgggaatgtaatgagtat

SEQ ID NO: 1553 - DNA, 26 bp, Homo sapiens
tagttcaagttcttctcaaaagcccc

SEQ ID NO: 1554 - DNA, 26 bp, Homo sapiens
ataaactgtggtgggcaaatgagtgt

SEQ ID NO: 1555 - DNA, 23 bp, Homo sapiens
cctgggcaacgagagcaaaactc

SEQ ID NO: 1556 - DNA, 26 bp, Homo sapiens
gagtaaggtaaagtcctctgtttcta

SEQ ID NO: 1557 - DNA, 26 bp, Homo sapiens
ccattcgccattcttccttacccagc

SEQ ID NO: 1558 - DNA, 23 bp, Homo sapiens
gaggaagtatgaccagggcaggg

SEQ ID NO: 1559 - DNA, 24 bp, Homo sapiens
agtaaacctgcctcctatttgata

SEQ ID NO: 1560 - DNA, 23 bp, Homo sapiens
ccaggacattctcagccaaggag

SEQ ID NO: 1561 - DNA, 24 bp, Homo sapiens
aggaacctaaactcacttctcagt

SEQ ID NO: 1562 - DNA, 24 bp, Homo sapiens
cagtccaaaagccaagaaagcata

SEQ ID NO: 1563 - DNA, 26 bp, Homo sapiens
caataactgaatggctgagtctgaaa

SEQ ID NO: 1564 - DNA, 23 bp, Homo sapiens
ctcttctgtttgtgagggctgcc

SEQ ID NO: 1565 - DNA, 26 bp, Homo sapiens
aacgagacagagtttggatgggttgc

SEQ ID NO: 1566 - DNA, 26 bp, Homo sapiens
ggtcacttgaagcaaccctttggaaa

SEQ ID NO: 1567 - DNA, 26 bp, Homo sapiens
ggattggacagcaccatttgccacaa

SEQ ID NO: 1568 - DNA, 23 bp, Homo sapiens
gcctgctgcgggtgacatttcaa

SEQ ID NO: 1569 - DNA, 26 bp, Homo sapiens
gagaagacaggaacactgatgctatc

SEQ ID NO: 1570 - DNA, 24 bp, Homo sapiens
cttttattttagatacagtggtgt

SEQ ID NO: 1571 - DNA, 26 bp, Homo sapiens
gaactcaaaggcaaatcggaaatgct

SEQ ID NO: 1572 - DNA, 26 bp, Homo sapiens
ttcaactggtaagacattctgaggaa

SEQ ID NO: 1573 - DNA, 26 bp, Homo sapiens
ctcaagtcctcatctgtagagtctgg

SEQ ID NO: 1574 - DNA, 60 bp, Homo sapiens
tccttggataggacattacatatcattttcgagtaatattaaagattccaggactcacaa

SEQ ID NO: 1575 - DNA, 60 bp, Homo sapiens; identical to SEQ ID NO: 1574

SEQ ID NO: 1576 - DNA, 60 bp, Homo sapiens
aaagaaattcttagctctagatttatcatcgaatcatgaaaagtgaaagtctgagctttg

SEQ ID NO: 1577 - DNA, 60 bp, Homo sapiens; identical to SEQ ID NO: 1576

SEQ ID NO: 1578 - DNA, 60 bp, Homo sapiens
ccttattttttatagttaagaatgtttttcgagttttggctgcttttctccccaagtaga

SEQ ID NO: 1579 - DNA, 60 bp, Homo sapiens; identical to SEQ ID NO: 1578

SEQ ID NO: 1580 - DNA, 60 bp, Homo sapiens
gcattgtttcttcattttattttatttttcgaagaactggaagaagagaaccaatggaaa

SEQ ID NO: 1581 - DNA, 60 bp, Homo sapiens; identical to SEQ ID NO: 1580

SEQ ID NO: 1582 - DNA, 60 bp, Homo sapiens
ttttgaaaatatgaaaaggaatttctgttcgatatatactgtacatctcaagaaatatgt

SEQ ID NO: 1583 - DNA, 60 bp, Homo sapiens; identical to SEQ ID NO: 1582

SEQ ID NO: 1584 - DNA, 60 bp, Homo sapiens
ctcaatcaaggatacttattattacttctcgaagccttaaagcttggagcattcctgcta

SEQ ID NO: 1585 - DNA, 60 bp, Homo sapiens; identical to SEQ ID NO: 1584

SEQ ID NO: 1586 - DNA, 60 bp, Homo sapiens
ttcaattttggtcaatttatttcaaccatcgaaaggtaggatctgagatcccaccctaaa

SEQ ID NO: 1587 - DNA, 60 bp, Homo sapiens; identical to SEQ ID NO: 1586

SEQ ID NO: 1588 - DNA, 60 bp, Homo sapiens
ctaaaatgaatcctaaaggtctttttgttcgacgcgtcttcattctagggttatattgag

SEQ ID NO: 1589 - DNA, 60 bp, Homo sapiens; identical to SEQ ID NO: 1588

SEQ ID NO: 1590 - DNA, 60 bp, Homo sapiens
tatgaagatgaatgaaaaaataaataaatcgaaataagaaactagggggaagaaattaat

SEQ ID NO: 1591 - DNA, 60 bp, Homo sapiens; identical to SEQ ID NO: 1590

SEQ ID NO: 1592 - DNA, 60 bp, Homo sapiens
ttcatagaaatgtcttagataatcattatcgagctcctcaagttgcatatggaaaacttg

SEQ ID NO: 1593 - DNA, 60 bp, Homo sapiens; identical to SEQ ID NO: 1592

SEQ ID NO: 1594 - DNA, 60 bp, Homo sapiens
ttgaaactttacaggaggtgattaagaatcgactgctctttgaactccactgtttaaaag

SEQ ID NO: 1595 - DNA, 60 bp, Homo sapiens; identical to SEQ ID NO: 1594

SEQ ID NO: 1596 - DNA, 60 bp, Homo sapiens
catatctgtgaatatttttttaaaaccatcgattcagctggggaaaaatgaaaataacaa

SEQ ID NO: 1597 - DNA, 60 bp, Homo sapiens; identical to SEQ ID NO: 1596

SEQ ID NO: 1598 - DNA, 60 bp, Homo sapiens
tcaaatttccatattttactttatcacctcgataaaaacaatgttcacactgatttgaca

SEQ ID NO: 1599 - DNA, 60 bp, Homo sapiens; identical to SEQ ID NO: 1598

SEQ ID NO: 1600 - DNA, 60 bp, Homo sapiens
ataaaaataaggtgggtagttttcaacttcgaaaaagaaaagaaaagaaaagaaaaccaa

SEQ ID NO: 1601 - DNA, 60 bp, Homo sapiens; identical to SEQ ID NO: 1600

SEQ ID NO: 1602 - DNA, 60 bp, Homo sapiens
aatatgaagaaatgaaatataaattgactcgacttaaaagcatattttaaaaaattggtt

SEQ ID NO: 1603 - DNA, 60 bp, Homo sapiens; identical to SEQ ID NO: 1602

SEQ ID NO: 1604 - DNA, 60 bp, Homo sapiens
atggtaaatgacttgtatttattagatatcgaatagtctctgtggtgattttcctcctag

SEQ ID NO: 1605 - DNA, 60 bp, Homo sapiens; identical to SEQ ID NO: 1604

SEQ ID NO: 1606 - DNA, 60 bp, Homo sapiens
gctattcaaataaacatgtattcctcattcgatgaggaaaatttctctttctaggaggct

SEQ ID NO: 1607 - DNA, 60 bp, Homo sapiens; identical to SEQ ID NO: 1606

SEQ ID NO: 1608 - DNA, 60 bp, Homo sapiens
gcccactaaatagtaatattaggatctatcgatgagaaagataaaaaggaggaggaggaa

SEQ ID NO: 1609 - DNA, 60 bp, Homo sapiens; identical to SEQ ID NO: 1608

SEQ ID NO: 1610 - DNA, 60 bp, Homo sapiens
gtcatcaatataaaaattattaatgcaatcgactcttaaataatctgaaagtactacttc

SEQ ID NO: 1611 - DNA, 60 bp, Homo sapiens; identical to SEQ ID NO: 1610

SEQ ID NO: 1612 - DNA, 60 bp, Homo sapiens
aaaatagtatatattcactctagaaaattcgaagcaacagcaaaactgtgaaatagatcc

SEQ ID NO: 1613 - DNA, 60 bp, Homo sapiens; identical to SEQ ID NO: 1612

SEQ ID NO: 1614 - DNA, 60 bp, Homo sapiens
atgtaaagaatttaaaaataatcagttgtcgaaagtctgtttgggaacagtgaagtgaac

SEQ ID NO: 1615 - DNA, 60 bp, Homo sapiens; identical to SEQ ID NO: 1614

SEQ ID NO: 1616 - DNA, 60 bp, Homo sapiens
ttcttgactaagtttagatatgcaaaattcgaaaagatcaatagaaatgggcagaaatgt

SEQ ID NO: 1617 - DNA, 60 bp, Homo sapiens; identical to SEQ ID NO: 1616

SEQ ID NO: 1618 - DNA, 60 bp, Homo sapiens
attagagaagcaaaattcttctctactttcgaaaaacatattggattggttttttcttca

SEQ ID NO: 1619 - DNA, 60 bp, Homo sapiens; identical to SEQ ID NO: 1618

SEQ ID NO: 1620 - DNA, 60 bp, Homo sapiens
gtgaaatccatgactttgaagtcatttttcgagggatttaagcgaaatagatttatataa

SEQ ID NO: 1621 - DNA, 60 bp, Homo sapiens; identical to SEQ ID NO: 1620

SEQ ID NO: 1622 - DNA, 60 bp, Homo sapiens
cgtaatgttatttttaaaaacgtacttttcgagtatccaatgtattaaccacccctttat

SEQ ID NO: 1623 - DNA, 60 bp, Homo sapiens; identical to SEQ ID NO: 1622

SEQ ID NO: 1624 - DNA, 60 bp, Homo sapiens
ataatgtataacacaaaatgtaagaagatcgaagttgagttggaaatgcttggtgcatca

SEQ ID NO: 1625 - DNA, 60 bp, Homo sapiens; identical to SEQ ID NO: 1624

SEQ ID NO: 1626 - DNA, 60 bp, Homo sapiens
gatagaaaaaaaggaatatattatcaactcgaatttctgtcaccattagtcgtgagactt

SEQ ID NO: 1627 - DNA, 60 bp, Homo sapiens; identical to SEQ ID NO: 1626

SEQ ID NO: 1628 - DNA, 60 bp, Homo sapiens
cttattttctgtaaactgaaaattagagtcgaaaacatacattgttgtgaaagtaaaata

SEQ ID NO: 1629 - DNA, 60 bp, Homo sapiens; identical to SEQ ID NO: 1628

SEQ ID NO: 1630 - DNA, 60 bp, Homo sapiens
attttacaaatggtttgcaaattctatttcgaaacctgaatcacagaattaggcttgact

SEQ ID NO: 1631 - DNA, 60 bp, Homo sapiens; identical to SEQ ID NO: 1630

SEQ ID NO: 1632 - DNA, 60 bp, Homo sapiens
atgtatttttcacaatatgaattaaaagtcgactcattttcatctgaaaagcctgtttag

SEQ ID NO: 1633 - DNA, 60 bp, Homo sapiens; identical to SEQ ID NO: 1632

SEQ ID NO: 1634 - DNA, 60 bp, Homo sapiens
tatttagctatagttttttctcactttatcgagatgatcaaaacgatcatagctattttg

SEQ ID NO: 1635 - DNA, 60 bp, Homo sapiens; identical to SEQ ID NO: 1634

SEQ ID NO: 1636 - DNA, 60 bp, Homo sapiens
atttccaggttaaaaaaaatagaagacatcgagtaagctctccatgaatgttgactattt

SEQ ID NO: 1637 - DNA, 60 bp, Homo sapiens; identical to SEQ ID NO: 1636

SEQ ID NO: 1638 - DNA, 60 bp, Homo sapiens
taaacaaaatctaggaggccattttttttcgattttcataaaacattgttcttattaagg

SEQ ID NO: 1639 - DNA, 60 bp, Homo sapiens; identical to SEQ ID NO: 1638

SEQ ID NO: 1640 - DNA, 60 bp, Homo sapiens
taagatagagaaattgatttttaaaacttcgatcatatgcttaaaactccagccacagtg

SEQ ID NO: 1641 - DNA, 60 bp, Homo sapiens; identical to SEQ ID NO: 1640

SEQ ID NO: 1642 - DNA, 60 bp, Homo sapiens
ttcgctcttgttttcttttttatttttatcgaaaaataaaaataaaaaaggagtttctca

SEQ ID NO: 1643 - DNA, 60 bp, Homo sapiens; identical to SEQ ID NO: 1642

SEQ ID NO: 1644 - DNA, 60 bp, Homo sapiens
tgccttctttaggtcgcttctgagcgactcgatttatcacagtaccaatcaccctaacta

SEQ ID NO: 1645 - DNA, 60 bp, Homo sapiens; identical to SEQ ID NO: 1644

SEQ ID NO: 1646 - DNA, 60 bp, Homo sapiens
cacttagtaagagttaattgttcatgtttcgataataaggaaatccacttctagaagagc

SEQ ID NO: 1647 - DNA, 60 bp, Homo sapiens; identical to SEQ ID NO: 1646

SEQ ID NO: 1648 - DNA, 60 bp, Homo sapiens
caaacatcaatagaaagtttataagaagtcgaagcaatatttaaaagcttagaggatgtt

SEQ ID NO: 1649 - DNA, 60 bp, Homo sapiens; identical to SEQ ID NO: 1648

SEQ ID NO: 1650 - DNA, 60 bp, Homo sapiens
ccctttaaaactcttaaatatattgtattcgacaaaaagttcacaaagaatgtagcttaa

SEQ ID NO: 1651 - DNA, 60 bp, Homo sapiens; identical to SEQ ID NO: 1650

SEQ ID NO: 1652 - DNA, 60 bp, Homo sapiens
tgtaaagaaaacaacggttgttttcaagtcgatttacctcctggatcttgttttctcatc

SEQ ID NO: 1653 - DNA, 60 bp, Homo sapiens; identical to SEQ ID NO: 1652

SEQ ID NO: 1654 - DNA, 60 bp, Homo sapiens
ttttttttcatttttattttcagaagtatcgattgcacagaaatcttcacatcacatctt

SEQ ID NO: 1655 - DNA, 60 bp, Homo sapiens; identical to SEQ ID NO: 1654

SEQ ID NO: 1656 - DNA, 60 bp, Homo sapiens
ttaatctactctctatctgtgtagattctcgaaataattcatgtcattcacttcaaagac

SEQ ID NO: 1657 - DNA, 60 bp, Homo sapiens; identical to SEQ ID NO: 1656

SEQ ID NO: 1658 - DNA, 60 bp, Homo sapiens
attaaaatataaaatggtaaatgtcatctcgaattctttcctctgaggaggcaagaattg

SEQ ID NO: 1659 - DNA, 60 bp, Homo sapiens; identical to SEQ ID NO: 1658

SEQ ID NO: 1660 - DNA, 60 bp, Homo sapiens
tattacagaaaaaaaaaaatggatctcttcgataaaaatgtacttcaaaaattggattgg

SEQ ID NO: 1661 - DNA, 60 bp, Homo sapiens; identical to SEQ ID NO: 1660

SEQ ID NO: 1662 - DNA, 60 bp, Homo sapiens
tatgaaaatataaaagaatataaagagttcgagatcagatttaaaagacagacaattcca

SEQ ID NO: 1663 - DNA, 60 bp, Homo sapiens; identical to SEQ ID NO: 1662

SEQ ID NO: 1664 - DNA, 60 bp, Homo sapiens
cttctgtttttatgcagatttaatgcagtcgatttacttttgttttaaaacaattgacaa

SEQ ID NO: 1665 - DNA, 60 bp, Homo sapiens; identical to SEQ ID NO: 1664

SEQ ID NO: 1666 - DNA, 60 bp, Homo sapiens
ttttaaatttttattatgattattattttcgatttatttaaacctgtctcctcacaagaa

SEQ ID NO: 1667 - DNA, 60 bp, Homo sapiens; identical to SEQ ID NO: 1666

SEQ ID NO: 1668 - DNA, 60 bp, Homo sapiens
aggctatttctagaaataagtattgccatcgagttactttcctgattcattgctcttagg

SEQ ID NO: 1669 - DNA, 60 bp, Homo sapiens; identical to SEQ ID NO: 1668

SEQ ID NO: 1670 - DNA, 60 bp, Homo sapiens
tgttgtgaacttttgaaacaaatttgtttcgaatctgagtgtatatttcttatcaagtca

SEQ ID NO: 1671 - DNA, 60 bp, Homo sapiens; identical to SEQ ID NO: 1670

SEQ ID NO: 1672 - DNA, 60 bp, Homo sapiens
tatgatgaaggatcaagattctataacatcgaaaaactacctattgagtactatgtttac

SEQ ID NO: 1673 - DNA, 60 bp, Homo sapiens; identical to SEQ ID NO: 1672

SEQ ID NO: 1674 - DNA, 60 bp, Homo sapiens
ctgtgggaaatttctttctttttctttttcgaccctttcagtgttcttccattctctctg

SEQ ID NO: 1675 - DNA, 60 bp, Homo sapiens; identical to SEQ ID NO: 1674

SEQ ID NO: 1676 - DNA, 60 bp, Homo sapiens
gatagaaaaaaaggaatatattatcaactcgaagggtcctgaatacaaaggtaaataaaa

SEQ ID NO: 1677 - DNA, 60 bp, Homo sapiens; identical to SEQ ID NO: 1676

SEQ ID NO: 1678 - DNA, 60 bp, Homo sapiens
tttcttgtatttcattatgtacatctattcgatgtcagtgtccatcaatggataaatgga

SEQ ID NO: 1679 - DNA, 60 bp, Homo sapiens; identical to SEQ ID NO: 1678

SEQ ID NO: 1680 - DNA, 60 bp, Homo sapiens
attaatttcttccccctagtttcttatttcgaattatttagatgattgtctcaatattcc

SEQ ID NO: 1681 - DNA, 60 bp, Homo sapiens; identical to SEQ ID NO: 1680

SEQ ID NO: 1682 - DNA, 60 bp, Homo sapiens
gaagtttcaacttgattctttctaactttcgatattactcaattccagtagaagatcctc

SEQ ID NO: 1683 - DNA, 60 bp, Homo sapiens; identical to SEQ ID NO: 1682

SEQ ID NO: 1684 - DNA, 23 bp, Homo sapiens
gctgtgtctctcccaggtaggct

SEQ ID NO: 1685 - DNA, 23 bp, Homo sapiens
gctgtgtctctcccaggtaggct

SEQ ID NO: 1686 - DNA, 23 bp, Homo sapiens
ctgcttccacgggcataacccat

SEQ ID NO: 1687 - DNA, 23 bp, Homo sapiens
ctgcttccacgggcataacccat

SEQ ID NO: 1688 - DNA, 24 bp, Homo sapiens
catccatacatttctaacttcatc

SEQ ID NO: 1689 - DNA, 24 bp, Homo sapiens
catccatacatttctaacttcatc

SEQ ID NO: 1690 - DNA, 23 bp, Homo sapiens
ggatgtccaagactctgctgctg

SEQ ID NO: 1691 - DNA, 23 bp, Homo sapiens
ggatgtccaagactctgctgctg

SEQ ID NO: 1692 - DNA, 26 bp, Homo sapiens
agaagtcccctggcgaagatgagcat

SEQ ID NO: 1693 - DNA, 26 bp, Homo sapiens
agaagtcccctggcgaagatgagcat

SEQ ID NO: 1694 - DNA, 23 bp, Homo sapiens
ggctactccacaggcagagcagc

SEQ ID NO: 1695 - DNA, 23 bp, Homo sapiens
ggctactccacaggcagagcagc

SEQ ID NO: 1696 - DNA, 26 bp, Homo sapiens
cttcatctaaacttcacaggcaaaag

SEQ ID NO: 1697 - DNA, 26 bp, Homo sapiens
cttcatctaaacttcacaggcaaaag

SEQ ID NO: 1698 - DNA, 26 bp, Homo sapiens
gttcacgcttcacttagaccttacag

SEQ ID NO: 1699 - DNA, 26 bp, Homo sapiens
gttcacgcttcacttagaccttacag

SEQ ID NO: 1700 - DNA, 23 bp, Homo sapiens
agtccttggcaggtaggtagcat

SEQ ID NO: 1701 - DNA, 23 bp, Homo sapiens
agtccttggcaggtaggtagcat

SEQ ID NO: 1702 - DNA, 26 bp, Homo sapiens
gtatttggtagttttactgtgtctcc

SEQ ID NO: 1703 - DNA, 26 bp, Homo sapiens
gtatttggtagttttactgtgtctcc

SEQ ID NO: 1704 - DNA, 26 bp, Homo sapiens
gtccccagcatttgtgatgtccccaa

SEQ ID NO: 1705 - DNA, 26 bp, Homo sapiens
gtccccagcatttgtgatgtccccaa

SEQ ID NO: 1706 - DNA, 23 bp, Homo sapiens
ggagcaggtttatggcttccagg

SEQ ID NO: 1707 - DNA, 23 bp, Homo sapiens
ggagcaggtttatggcttccagg

SEQ ID NO: 1708 - DNA, 26 bp, Homo sapiens
gcacgattacccctttattccagact

SEQ ID NO: 1709 - DNA, 26 bp, Homo sapiens
gcacgattacccctttattccagact

SEQ ID NO: 1710 - DNA, 24 bp, Homo sapiens
ttattgagcactgaggagttctat

SEQ ID NO: 1711 - DNA, 24 bp, Homo sapiens
ttattgagcactgaggagttctat

SEQ ID NO: 1712 - DNA, 26 bp, Homo sapiens
gcttctctcttcttgccttctgccca

SEQ ID NO: 1713 - DNA, 26 bp, Homo sapiens
gcttctctcttcttgccttctgccca

SEQ ID NO: 1714 - DNA, 26 bp, Homo sapiens
gccctcttagattgatgccagaagta

SEQ ID NO: 1715 - DNA, 26 bp, Homo sapiens
gccctcttagattgatgccagaagta

SEQ ID NO: 1716 - DNA, 26 bp, Homo sapiens
ctgccctcttcctttccctcctgtat

SEQ ID NO: 1717 - DNA, 26 bp, Homo sapiens
ctgccctcttcctttccctcctgtat

SEQ ID NO: 1718 - DNA, 26 bp, Homo sapiens
gcctaagtccagtagtatggtggctg

SEQ ID NO: 1719 - DNA, 26 bp, Homo sapiens
gcctaagtccagtagtatggtggctg

SEQ ID NO: 1720 - DNA, 23 bp, Homo sapiens
ggtgctacactctaaggcagcgt

SEQ ID NO: 1721 - DNA, 23 bp, Homo sapiens
ggtgctacactctaaggcagcgt

SEQ ID NO: 1722 - DNA, 23 bp, Homo sapiens
ccctcaacactgctcctccaaga

SEQ ID NO: 1723 - DNA, 23 bp, Homo sapiens
ccctcaacactgctcctccaaga

SEQ ID NO: 1724 - DNA, 24 bp, Homo sapiens
tttggcaaggcatagaatagaata

SEQ ID NO: 1725 - DNA, 24 bp, Homo sapiens
tttggcaaggcatagaatagaata

SEQ ID NO: 1726 - DNA, 24 bp, Homo sapiens
taaagacaggcttgtgccagaaat

SEQ ID NO: 1727 - DNA, 24 bp, Homo sapiens
taaagacaggcttgtgccagaaat

SEQ ID NO: 1728 - DNA, 26 bp, Homo sapiens
ggagggagggaaagagggactatgaa

SEQ ID NO: 1729 - DNA, 26 bp, Homo sapiens
ggagggagggaaagagggactatgaa

SEQ ID NO: 1730 - DNA, 25 bp, Homo sapiens
ttttccgtggagtgaacaaagccca

SEQ ID NO: 1731 - DNA, 25 bp, Homo sapiens
ttttccgtggagtgaacaaagccca

SEQ ID NO: 1732 - DNA, 26 bp, Homo sapiens
tgtagagccaaatagccacagggata

SEQ ID NO: 1733 - DNA, 26 bp, Homo sapiens
tgtagagccaaatagccacagggata

SEQ ID NO: 1734 - DNA, 23 bp, Homo sapiens
ctcagttgtggaccagagcagat

SEQ ID NO: 1735 - DNA, 23 bp, Homo sapiens
ctcagttgtggaccagagcagat

SEQ ID NO: 1736 - DNA, 26 bp, Homo sapiens
atggctccaggatgaatgatgactgc

SEQ ID NO: 1737 - DNA, 26 bp, Homo sapiens
atggctccaggatgaatgatgactgc

SEQ ID NO: 1738 - DNA, 26 bp, Homo sapiens
gttcaacttttcctgattgtcacagc

SEQ ID NO: 1739 - DNA, 26 bp, Homo sapiens
gttcaacttttcctgattgtcacagc

SEQ ID NO: 1740 - DNA, 24 bp, Homo sapiens
atttacattcctccacttcattta

SEQ ID NO: 1741 - DNA, 24 bp, Homo sapiens
atttacattcctccacttcattta

SEQ ID NO: 1742 - DNA, 23 bp, Homo sapiens
ggagaaggttccagaagccgcct

SEQ ID NO: 1743 - DNA, 23 bp, Homo sapiens
ggagaaggttccagaagccgcct

SEQ ID NO: 1744 - DNA, 26 bp, Homo sapiens
ggaatagccttgcttgttttgtggca

SEQ ID NO: 1745 - DNA, 26 bp, Homo sapiens
ggaatagccttgcttgttttgtggca

SEQ ID NO: 1746 - DNA, 26 bp, Homo sapiens
gggcttccagacataagacacaacta

SEQ ID NO: 1747 - DNA, 26 bp, Homo sapiens
gggcttccagacataagacacaacta

SEQ ID NO: 1748 - DNA, 26 bp, Homo sapiens
attctcctttgccccttctcctcctc

SEQ ID NO: 1749 - DNA, 26 bp, Homo sapiens
attctcctttgccccttctcctcctc

SEQ ID NO: 1750 - DNA, 26 bp, Homo sapiens
ctgagaatgattgtggttacctgttc

SEQ ID NO: 1751 - DNA, 26 bp, Homo sapiens
ctgagaatgattgtggttacctgttc

SEQ ID NO: 1752 - DNA, 23 bp, Homo sapiens
ggcagtcttcattcttggctcta

SEQ ID NO: 1753 - DNA, 23 bp, Homo sapiens
ggcagtcttcattcttggctcta

SEQ ID NO: 1754 - DNA, 23 bp, Homo sapiens
agtctatctcgtggaggttcggc

SEQ ID NO: 1755 - DNA, 23 bp, Homo sapiens
agtctatctcgtggaggttcggc

SEQ ID NO: 1756 - DNA, 26 bp, Homo sapiens
ttgtgccaccacttttccattagtat

SEQ ID NO: 1757 - DNA, 26 bp, Homo sapiens
ttgtgccaccacttttccattagtat

SEQ ID NO: 1758 - DNA, 24 bp, Homo sapiens
tcatacttttggatgttacttaca

SEQ ID NO: 1759 - DNA, 24 bp, Homo sapiens
tcatacttttggatgttacttaca

SEQ ID NO: 1760 - DNA, 26 bp, Homo sapiens
ccctttgagattttggataggagttt

SEQ ID NO: 1761 - DNA, 26 bp, Homo sapiens
ccctttgagattttggataggagttt

SEQ ID NO: 1762 - DNA, 26 bp, Homo sapiens
gggaaagtctattgaccaacactgct

SEQ ID NO: 1763 - DNA, 26 bp, Homo sapiens
gggaaagtctattgaccaacactgct

SEQ ID NO: 1764 - DNA, 23 bp, Homo sapiens
cggtagacacctcttttccctgc

SEQ ID NO: 1765 - DNA, 23 bp, Homo sapiens
cggtagacacctcttttccctgc

SEQ ID NO: 1766 - DNA, 26 bp, Homo sapiens
gcaatccctccagcccttgtcaatca

SEQ ID NO: 1767 - DNA, 26 bp, Homo sapiens
gcaatccctccagcccttgtcaatca

SEQ ID NO: 1768 - DNA, 26 bp, Homo sapiens
ggtgagacatagtagcaaggaagagg

SEQ ID NO: 1769 - DNA, 26 bp, Homo sapiens
ggtgagacatagtagcaaggaagagg

SEQ ID NO: 1770 - DNA, 26 bp, Homo sapiens
aatctgaacttagacaggctggctgc

SEQ ID NO: 1771 - DNA, 26 bp, Homo sapiens
aatctgaacttagacaggctggctgc

SEQ ID NO: 1772 - DNA, 26 bp, Homo sapiens
gctaaccaccagagtcacacacatca

SEQ ID NO: 1773 - DNA, 26 bp, Homo sapiens
gctaaccaccagagtcacacacatca

SEQ ID NO: 1774 - DNA, 24 bp, Homo sapiens
cacacctacaagtattttagttta

SEQ ID NO: 1775 - DNA, 24 bp, Homo sapiens
cacacctacaagtattttagttta

SEQ ID NO: 1776 - DNA, 23 bp, Homo sapiens
ctgttcaaacccgtcagcaggat

SEQ ID NO: 1777 - DNA, 23 bp, Homo sapiens
ctgttcaaacccgtcagcaggat

SEQ ID NO: 1778 - DNA, 26 bp, Homo sapiens
atccctaccaacagtaatcagcaaaa

SEQ ID NO: 1779 - DNA, 26 bp, Homo sapiens
atccctaccaacagtaatcagcaaaa

SEQ ID NO: 1780 - DNA, 24 bp, Homo sapiens
tgccattcacacaaagtctaaggg

SEQ ID NO: 1781 - DNA, 24 bp, Homo sapiens
tgccattcacacaaagtctaaggg

SEQ ID NO: 1782 - DNA, 26 bp, Homo sapiens
ggagtgtctctttgggtctcaatcat

SEQ ID NO: 1783 - DNA, 26 bp, Homo sapiens
ggagtgtctctttgggtctcaatcat

SEQ ID NO: 1784 - DNA, 26 bp, Homo sapiens
acgcacttaggaggattgtgtgtgtg

SEQ ID NO: 1785 - DNA, 26 bp, Homo sapiens
acgcacttaggaggattgtgtgtgtg

SEQ ID NO: 1786 - DNA, 26 bp, Homo sapiens
cttcctcttcagttactttcatccac

SEQ ID NO: 1787 - DNA, 26 bp, Homo sapiens
cttcctcttcagttactttcatccac

SEQ ID NO: 1788 - DNA, 24 bp, Homo sapiens
tcagtgtttgcttttcccttgaat

SEQ ID NO: 1789 - DNA, 24 bp, Homo sapiens
tcagtgtttgcttttcccttgaat

SEQ ID NO: 1790 - DNA, 24 bp, Homo sapiens
gatgaagtcttgctatgttgccta

SEQ ID NO: 1791 - DNA, 24 bp, Homo sapiens
gatgaagtcttgctatgttgccta

SEQ ID NO: 1792 - DNA, 26 bp, Homo sapiens
ccaataaccttccagcatctccctga

SEQ ID NO: 1793 - DNA, 26 bp, Homo sapiens
ccaataaccttccagcatctccctga

SEQ ID NO: 1794 - DNA, 23 bp, Homo sapiens
gcaccatcaggcttctgggaatg

SEQ ID NO: 1795 - DNA, 23 bp, Homo sapiens
gcaccatcaggcttctgggaatg

SEQ ID NO: 1796 - DNA, 23 bp, Homo sapiens
cccacagggttggcagtgagatg

SEQ ID NO: 1797 - DNA, 23 bp, Homo sapiens
cccacagggttggcagtgagatg

SEQ ID NO: 1798 - DNA, 24 bp, Homo sapiens
ttctctattcttcccttccctttt

SEQ ID NO: 1799 - DNA, 24 bp, Homo sapiens
ttctctattcttcccttccctttt

SEQ ID NO: 1800 - DNA, 23 bp, Homo sapiens
ggcacccagaggctcctttggaa

SEQ ID NO: 1801 - DNA, 23 bp, Homo sapiens
ggcacccagaggctcctttggaa

SEQ ID NO: 1802 - DNA, 26 bp, Homo sapiens
gctgtggactgggtaaataaagtgtg

SEQ ID NO: 1803 - DNA, 26 bp, Homo sapiens
gctgtggactgggtaaataaagtgtg

SEQ ID NO: 1804 - DNA, 25 bp, Homo sapiens
gcagggatgaggatagtaaaccaat

SEQ ID NO: 1805 - DNA, 25 bp, Homo sapiens
gcagggatgaggatagtaaaccaat

SEQ ID NO: 1806 - DNA, 26 bp, Homo sapiens
ttcatcactcctttcatctcaccagc

SEQ ID NO: 1807 - DNA, 26 bp, Homo sapiens
ttcatcactcctttcatctcaccagc

SEQ ID NO: 1808 - DNA, 26 bp, Homo sapiens
cttaggcaacaatgtgtgggctcctg

SEQ ID NO: 1809 - DNA, 26 bp, Homo sapiens
cttaggcaacaatgtgtgggctcctg

SEQ ID NO: 1810 - DNA, 26 bp, Homo sapiens
gagatgaagtcttgctatgttgccta

SEQ ID NO: 1811 - DNA, 26 bp, Homo sapiens
gagatgaagtcttgctatgttgccta

SEQ ID NO: 1812 - DNA, 26 bp, Homo sapiens
gctgacaggcaaggtgaaaatcaaca

SEQ ID NO: 1813 - DNA, 26 bp, Homo sapiens
gctgacaggcaaggtgaaaatcaaca

SEQ ID NO: 1814 - DNA, 26 bp, Homo sapiens
ccatagagggtaggtaggacttcaat

SEQ ID NO: 1815 - DNA, 26 bp, Homo sapiens
ccatagagggtaggtaggacttcaat

SEQ ID NO: 1816 - DNA, 23 bp, Homo sapiens
cctggctgaagacctggctactc

SEQ ID NO: 1817 - DNA, 23 bp, Homo sapiens
cctggctgaagacctggctactc

SEQ ID NO: 1818 - DNA, 26 bp, Homo sapiens
ggttgcctgtgtggtgataggtgaca

SEQ ID NO: 1819 - DNA, 26 bp, Homo sapiens
ggttgcctgtgtggtgataggtgaca

SEQ ID NO: 1820 - DNA, 24 bp, Homo sapiens
aaatcatccccaatccagaactga

SEQ ID NO: 1821 - DNA, 24 bp, Homo sapiens
aaatcatccccaatccagaactga

SEQ ID NO: 1822 - DNA, 26 bp, Homo sapiens
ggaatgaaacagggcacagaataagg

SEQ ID NO: 1823 - DNA, 26 bp, Homo sapiens
ggaatgaaacagggcacagaataagg

SEQ ID NO: 1824 - DNA, 26 bp, Homo sapiens
aacagagaggctgaggtgcccacatt

SEQ ID NO: 1825 - DNA, 26 bp, Homo sapiens
aacagagaggctgaggtgcccacatt

SEQ ID NO: 1826 - DNA, 26 bp, Homo sapiens
ggagcagagacttgaatacaatgagg

SEQ ID NO: 1827 - DNA, 26 bp, Homo sapiens
ggagcagagacttgaatacaatgagg

SEQ ID NO: 1828 - DNA, 26 bp, Homo sapiens
cttatcaacaggcttactctcacctc

SEQ ID NO: 1829 - DNA, 26 bp, Homo sapiens
cttatcaacaggcttactctcacctc

SEQ ID NO: 1830 - DNA, 23 bp, Homo sapiens
ccacctttctcctgaagccagcc

SEQ ID NO: 1831 - DNA, 23 bp, Homo sapiens
ccacctttctcctgaagccagcc

SEQ ID NO: 1832 - DNA, 23 bp, Homo sapiens
aggaaccaggcacccattcaggg

SEQ ID NO: 1833 - DNA, 23 bp, Homo sapiens
aggaaccaggcacccattcaggg

SEQ ID NO: 1834 - DNA, 24 bp, Homo sapiens
tctaaaccccactggtcatctcag

SEQ ID NO: 1835 - DNA, 24 bp, Homo sapiens
tctaaaccccactggtcatctcag

SEQ ID NO: 1836 - DNA, 24 bp, Homo sapiens
gtagaatgggttgacctgataagc

SEQ ID NO: 1837 - DNA, 24 bp, Homo sapiens
gtagaatgggttgacctgataagc

SEQ ID NO: 1838 - DNA, 26 bp, Homo sapiens
ctctaagtccctgaacacagtaagaa

SEQ ID NO: 1839 - DNA, 26 bp, Homo sapiens
ctctaagtccctgaacacagtaagaa

SEQ ID NO: 1840 - DNA, 26 bp, Homo sapiens
ggcatcacagtggactccctcaaaca

SEQ ID NO: 1841 - DNA, 26 bp, Homo sapiens
ggcatcacagtggactccctcaaaca

SEQ ID NO: 1842 - DNA, 26 bp, Homo sapiens
ccaccttcgcctcctgtgttgttatg

SEQ ID NO: 1843 - DNA, 26 bp, Homo sapiens
ccaccttcgcctcctgtgttgttatg

SEQ ID NO: 1844 - DNA, 26 bp, Homo sapiens
caccccacactgtcactctttgctct

SEQ ID NO: 1845 - DNA, 26 bp, Homo sapiens
caccccacactgtcactctttgctct

SEQ ID NO: 1846 - DNA, 26 bp, Homo sapiens
ggaaatgctccgccgaatacaatgac

SEQ ID NO: 1847 - DNA, 26 bp, Homo sapiens
ggaaatgctccgccgaatacaatgac

SEQ ID NO: 1848 - DNA, 26 bp, Homo sapiens
gtctgtgtgtctttgtgtgcctttcc

SEQ ID NO: 1849 - DNA, 26 bp, Homo sapiens
gtctgtgtgtctttgtgtgcctttcc

SEQ ID NO: 1850 - DNA, 24 bp, Homo sapiens
agaaatcaccaacagcagaaccat

SEQ ID NO: 1851 - DNA, 24 bp, Homo sapiens
agaaatcaccaacagcagaaccat

SEQ ID NO: 1852 - DNA, 23 bp, Homo sapiens
gcgtccaatcagaacttgcgagc

SEQ ID NO: 1853 - DNA, 23 bp, Homo sapiens
gcgtccaatcagaacttgcgagc

SEQ ID NO: 1854 - DNA, 26 bp, Homo sapiens
gagaagggaggtaaaatgtaatcaac

SEQ ID NO: 1855 - DNA, 26 bp, Homo sapiens
gagaagggaggtaaaatgtaatcaac

SEQ ID NO: 1856 - DNA, 26 bp, Homo sapiens
gtggctacacccgagagggaaactaa

SEQ ID NO: 1857 - DNA, 26 bp, Homo sapiens
gtggctacacccgagagggaaactaa

SEQ ID NO: 1858 - DNA, 26 bp, Homo sapiens
ggtgtccttatcagtaaacaacttcc

SEQ ID NO: 1859 - DNA, 26 bp, Homo sapiens
ggtgtccttatcagtaaacaacttcc

SEQ ID NO: 1860 - DNA, 23 bp, Homo sapiens
aatccccagcagggtttcctaat

SEQ ID NO: 1861 - DNA, 23 bp, Homo sapiens
aatccccagcagggtttcctaat

SEQ ID NO: 1862 - DNA, 25 bp, Homo sapiens
gattcttggttgttggctgggatta

SEQ ID NO: 1863 - DNA, 25 bp, Homo sapiens
gattcttggttgttggctgggatta

SEQ ID NO: 1864 - DNA, 23 bp, Homo sapiens
ggagcaggtggaccatctgttcc

SEQ ID NO: 1865 - DNA, 23 bp, Homo sapiens
ggagcaggtggaccatctgttcc

SEQ ID NO: 1866 - DNA, 26 bp, Homo sapiens
actgactgatttgggtctgatggtgg

SEQ ID NO: 1867 - DNA, 26 bp, Homo sapiens
actgactgatttgggtctgatggtgg

SEQ ID NO: 1868 - DNA, 24 bp, Homo sapiens
tagtatgtctgctgaaggcactta

SEQ ID NO: 1869 - DNA, 24 bp, Homo sapiens
tagtatgtctgctgaaggcactta

SEQ ID NO: 1870 - DNA, 26 bp, Homo sapiens
tttcctatcttcccacctcttctgcc

SEQ ID NO: 1871 - DNA, 26 bp, Homo sapiens
tttcctatcttcccacctcttctgcc

SEQ ID NO: 1872 - DNA, 26 bp, Homo sapiens
tctccaagaggcaactgcttagacag

SEQ ID NO: 1873 - DNA, 26 bp, Homo sapiens
tctccaagaggcaactgcttagacag

SEQ ID NO: 1874 - DNA, 24 bp, Homo sapiens
gtgccttccaccagagtccacatc

SEQ ID NO: 1875 - DNA, 24 bp, Homo sapiens
gtgccttccaccagagtccacatc

SEQ ID NO: 1876 - DNA, 26 bp, Homo sapiens
gccaagcaggttttgataatccaagg

SEQ ID NO: 1877 - DNA, 26 bp, Homo sapiens
gccaagcaggttttgataatccaagg

SEQ ID NO: 1878 - DNA, 26 bp, Homo sapiens
ctccgctcttggatttctgcccatta

SEQ ID NO: 1879 - DNA, 26 bp, Homo sapiens
ctccgctcttggatttctgcccatta

SEQ ID NO: 1880 - DNA, 26 bp, Homo sapiens
ggacataagcccaaacaggaacactg

SEQ ID NO: 1881 - DNA, 26 bp, Homo sapiens
ggacataagcccaaacaggaacactg

SEQ ID NO: 1882 - DNA, 26 bp, Homo sapiens
ccatcccagtttcaccattggcaaga

SEQ ID NO: 1883 - DNA, 26 bp, Homo sapiens
ccatcccagtttcaccattggcaaga

SEQ ID NO: 1884 - DNA, 24 bp, Homo sapiens
tttagagcggtgagacagtgacac

SEQ ID NO: 1885 - DNA, 24 bp, Homo sapiens
tttagagcggtgagacagtgacac

SEQ ID NO: 1886 - DNA, 23 bp, Homo sapiens
ccgccccagcctcccaaagtgct

SEQ ID NO: 1887 - DNA, 23 bp, Homo sapiens
ccgccccagcctcccaaagtgct

SEQ ID NO: 1888 - DNA, 26 bp, Homo sapiens
gggatagttagaaagagaagatgaga

SEQ ID NO: 1889 - DNA, 26 bp, Homo sapiens
gggatagttagaaagagaagatgaga

SEQ ID NO: 1890 - DNA, 25 bp, Homo sapiens
cttttgaatagttcttactttatgc

SEQ ID NO: 1891 - DNA, 25 bp, Homo sapiens
cttttgaatagttcttactttatgc

SEQ ID NO: 1892 - DNA, 26 bp, Homo sapiens
gggtaggcaactaactgaggctgcta

SEQ ID NO: 1893 - DNA, 26 bp, Homo sapiens
gggtaggcaactaactgaggctgcta

SEQ ID NO: 1894 - DNA, 26 bp, Homo sapiens
ggaagggagagtgctggacatttcat

SEQ ID NO: 1895 - DNA, 26 bp, Homo sapiens
ggaagggagagtgctggacatttcat

SEQ ID NO: 1896 - DNA, 26 bp, Homo sapiens
ttcccaccccaggcattctctttcag

SEQ ID NO: 1897 - DNA, 26 bp, Homo sapiens
ttcccaccccaggcattctctttcag

SEQ ID NO: 1898 - DNA, 24 bp, Homo sapiens
ctgaaaatgacaagacctccttct

SEQ ID NO: 1899 - DNA, 24 bp, Homo sapiens
ctgaaaatgacaagacctccttct

SEQ ID NO: 1900 - DNA, 24 bp, Homo sapiens
ttgccatctctttgttcaagtttt

SEQ ID NO: 1901 - DNA, 24 bp, Homo sapiens
ttgccatctctttgttcaagtttt

SEQ ID NO: 1902 - DNA, 26 bp, Homo sapiens
ccaactgtgccaaaggatgatgatgg

SEQ ID NO: 1903 - DNA, 26 bp, Homo sapiens
ccaactgtgccaaaggatgatgatgg

SEQ ID NO: 1904 - DNA, 60 bp, Homo sapiens
cctctttttacatgtctccttttccctctcgaagtgactcacttctaaaacttgggctgc

SEQ ID NO: 1905 - DNA, 60 bp, Homo sapiens; identical to SEQ ID NO: 1904

SEQ ID NO: 1906 - DNA, 60 bp, Homo sapiens
caaatatcattatgtatcttttctgatatcgagaaccagatgttatactttggagactcc

SEQ ID NO: 1907 - DNA, 60 bp, Homo sapiens; identical to SEQ ID NO: 1906

SEQ ID NO: 1908 - DNA, 60 bp, Homo sapiens
gattaatagtaacaatagtaaataatgctcgagttgtactaaaagggtactgctagtgcc

SEQ ID NO: 1909 - DNA, 60 bp, Homo sapiens; identical to SEQ ID NO: 1908

SEQ ID NO: 1910 - DNA, 60 bp, Homo sapiens
catgtcacttgtgccatgtagcacatggtcgatacttatccaccatgaagcttaagagaa

SEQ ID NO: 1911 - DNA, 60 bp, Homo sapiens; identical to SEQ ID NO: 1910

SEQ ID NO: 1912 - DNA, 60 bp, Homo sapiens
ttggaactacttcttaggaccttaaatttcgaaacatggttgaaagctttctgacagagc

SEQ ID NO: 1913 - DNA, 60 bp, Homo sapiens; identical to SEQ ID NO: 1912

SEQ ID NO: 1914 - DNA, 60 bp, Homo sapiens
atgctaaattatgtaaaatggaatatgttcgaactaggcagtctgacttttctatgtgtg

SEQ ID NO: 1915 - DNA, 60 bp, Homo sapiens; identical to SEQ ID NO: 1914

SEQ ID NO: 1916 - DNA, 60 bp, Homo sapiens
atcatttttttttcaagcttagcctcattcgagactgaaatgtttttaacaaggactttg

SEQ ID NO: 1917 - DNA, 60 bp, Homo sapiens; identical to SEQ ID NO: 1916

SEQ ID NO: 1918 - DNA, 60 bp, Homo sapiens
ttcagtcattaatgagttaataaaaatctcgatattgttccttcccatgtttgtaaaagg

SEQ ID NO: 1919 - DNA, 60 bp, Homo sapiens; identical to SEQ ID NO: 1918

SEQ ID NO: 1920 - DNA, 60 bp, Homo sapiens
taaatgtatattgtcttcctaaaacaaatcgaacgttagttctcaattctttgaggaatt

SEQ ID NO: 1921 - DNA, 60 bp, Homo sapiens; identical to SEQ ID NO: 1920

SEQ ID NO: 1922 - DNA, 60 bp, Homo sapiens
gtactttcatcatttagttctaagcatttcgattcatgtctttctttcctttagctgaca

SEQ ID NO: 1923 - DNA, 60 bp, Homo sapiens; identical to SEQ ID NO: 1922

SEQ ID NO: 1924 - DNA, 60 bp, Homo sapiens
taaaataggtctataaattatacttcagtcgaatttaatctgcgtctgatatgctggcag

SEQ ID NO: 1925 - DNA, 60 bp, Homo sapiens; identical to SEQ ID NO: 1924

SEQ ID NO: 1926 - DNA, 60 bp, Homo sapiens
ttttaaaggatatacacatctatcactatcgaaaaggccaagctacttctagaacagtat

SEQ ID NO: 1927 - DNA, 60 bp, Homo sapiens; identical to SEQ ID NO: 1926

SEQ ID NO: 1928 - DNA, 60 bp, Homo sapiens
atgtatttttcacaatatgaattaaaagtcgaacatttgtccaagttttcttttggaaaa

SEQ ID NO: 1929 - DNA, 60 bp, Homo sapiens; identical to SEQ ID NO: 1928

SEQ ID NO: 1930 - DNA, 60 bp, Homo sapiens
ttaaagcaagttatgtaggtaattaatttcgaaatagtgggaatattgtaatagtcttta

SEQ ID NO: 1931 - DNA, 60 bp, Homo sapiens; identical to SEQ ID NO: 1930

SEQ ID NO: 1932 - DNA, 60 bp, Homo sapiens
ggtcattattaagtaaaataagggttactcgaagcctagctacaatccttcaagaatcct

SEQ ID NO: 1933 - DNA, 60 bp, Homo sapiens; identical to SEQ ID NO: 1932

SEQ ID NO: 1934 - DNA, 60 bp, Homo sapiens
aaagatcgtgtggaagaaatttctctgttcgatattgttccttcccatgtttgtaaaagg

SEQ ID NO: 1935 - DNA, 60 bp, Homo sapiens; identical to SEQ ID NO: 1934

SEQ ID NO: 1936 - DNA, 60 bp, Homo sapiens
acttagtaggatttttttattaaaattttcgaggaaccacagtgatgctgtattttgtaa

SEQ ID NO: 1937 - DNA, 60 bp, Homo sapiens; identical to SEQ ID NO: 1936

SEQ ID NO: 1938 - DNA, 60 bp, Homo sapiens
cttttgacatttcttttgttgttatttttcgataaagaatatgaacgctagctcttatgt

SEQ ID NO: 1939 - DNA, 60 bp, Homo sapiens; identical to SEQ ID NO: 1938

SEQ ID NO: 1940 - DNA, 60 bp, Homo sapiens
cttaaaaaaaaaaaaaatctgtgaactttcgaaagcataggagcaactaggagatttatg

SEQ ID NO: 1941 - DNA, 60 bp, Homo sapiens; identical to SEQ ID NO: 1940

SEQ ID NO: 1942 - DNA, 60 bp, Homo sapiens
actggagtttttcaaagatttttttgtatcgactagggagaggcttagatactttagtgt

SEQ ID NO: 1943 - DNA, 60 bp, Homo sapiens; identical to SEQ ID NO: 1942

SEQ ID NO: 1944 - DNA, 60 bp, Homo sapiens
gatgagtaacatagtagaaaaaaatacttcgatgtcacctttttctttgctctttggtag

SEQ ID NO: 1945 - DNA, 60 bp, Homo sapiens; identical to SEQ ID NO: 1944

SEQ ID NO: 1946 - DNA, 60 bp, Homo sapiens
aatataggaatattagtaaaatggtgtatcgacccagctccacgtggagctggctcctca

SEQ ID NO: 1947 - DNA, 60 bp, Homo sapiens; identical to SEQ ID NO: 1946

SEQ ID NO: 1948 - DNA, 60 bp, Homo sapiens
ataaagagctcggaagtgagctctttagtcgactctgcaatttttcgcatcaaagttcac

SEQ ID NO: 1949 - DNA, 60 bp, Homo sapiens; identical to SEQ ID NO: 1948

SEQ ID NO: 1950 - DNA, 60 bp, Homo sapiens
gtcacagagatctaatcctatgttttcttcgacacaacgtgttagattctaccaagaact

SEQ ID NO: 1951 - DNA, 60 bp, Homo sapiens; identical to SEQ ID NO: 1950

SEQ ID NO: 1952 - DNA, 60 bp, Homo sapiens
gttactttacagtaatataatttgtaactcgagtcactccttttttttaattttaagtat

SEQ ID NO: 1953 - DNA, 60 bp, Homo sapiens; identical to SEQ ID NO: 1952

SEQ ID NO: 1954 - DNA, 60 bp, Homo sapiens
ttgtgcttttattccaatgtttaatttatcgatagcccaggaaaagagcaaaattcaaag

SEQ ID NO: 1955 - DNA, 60 bp, Homo sapiens; identical to SEQ ID NO: 1954

SEQ ID NO: 1956 - DNA, 60 bp, Homo sapiens
gtactatagtgacaaagtagttgtcacatcgaaggaaaaaattgatatacagaatgaagc

SEQ ID NO: 1957 - DNA, 60 bp, Homo sapiens; identical to SEQ ID NO: 1956

SEQ ID NO: 1958 - DNA, 60 bp, Homo sapiens
acaagatccttgagaatcatttctgccttcgaatcttgataagagaaatgccaagaggtt

SEQ ID NO: 1959 - DNA, 60 bp, Homo sapiens; identical to SEQ ID NO: 1958

SEQ ID NO: 1960 - DNA, 60 bp, Homo sapiens
tgtcaattttcaatataattcatacagttcgagtaaaggtggacttgacttgagaagata

SEQ ID NO: 1961 - DNA, 60 bp, Homo sapiens; identical to SEQ ID NO: 1960

SEQ ID NO: 1962 - DNA, 60 bp, Homo sapiens
ttcttttatttcatataaagatgaagtctcgagacctcatgacaatctccaaaagtaggt

SEQ ID NO: 1963 - DNA, 60 bp, Homo sapiens; identical to SEQ ID NO: 1962

SEQ ID NO: 1964 - DNA, 60 bp, Homo sapiens
ttcttgaactaaagatcttaaaaggccttcgaatttcctaacttccaggatgatattctt

SEQ ID NO: 1965 - DNA, 60 bp, Homo sapiens; identical to SEQ ID NO: 1964

SEQ ID NO: 1966 - DNA, 60 bp, Homo sapiens
aaatattcaagattcagatgaattcaaatcgatgctacatatgattgcttgatttctaaa

SEQ ID NO: 1967 - DNA, 60 bp, Homo sapiens; identical to SEQ ID NO: 1966

SEQ ID NO: 1968 - DNA, 60 bp, Homo sapiens
ttcctttatattttgtttgtcttctttatcgagttcttctcttagaaatatttcctgaca

SEQ ID NO: 1969 - DNA, 60 bp, Homo sapiens; identical to SEQ ID NO: 1968

SEQ ID NO: 1970 - DNA, 60 bp, Homo sapiens
ttaaatatatcatgattttaaatgttcttcgatgagtgaatgagggaacaagtaatgtct

SEQ ID NO: 1971 - DNA, 60 bp, Homo sapiens; identical to SEQ ID NO: 1970

SEQ ID NO: 1972 - DNA, 60 bp, Homo sapiens
tattcagtatctactagggaggatttaatcgaaacccataaaatgtacaacacaacagga

SEQ ID NO: 1973 - DNA, 60 bp, Homo sapiens; identical to SEQ ID NO: 1972

SEQ ID NO: 1974 - DNA, 60 bp, Homo sapiens
tttagtattagaaatgttttggtctttatcgagatgaagtgtgtgaaagaaaagttactg

SEQ ID NO: 1975 - DNA, 60 bp, Homo sapiens; identical to SEQ ID NO: 1974

SEQ ID NO: 1976 - DNA, 60 bp, Homo sapiens
atatatgacctaacctattaaaaagagatcgagtaggaggcttaacattgtttttcttag

SEQ ID NO: 1977 - DNA, 60 bp, Homo sapiens; identical to SEQ ID NO: 1976

SEQ ID NO: 1978 - DNA, 60 bp, Homo sapiens
catggcttctttcctagaaaaattgtcttcgaatgagacataagtagtgatttgaagaat

SEQ ID NO: 1979 - DNA, 60 bp, Homo sapiens; identical to SEQ ID NO: 1978

SEQ ID NO: 1980 - DNA, 60 bp, Homo sapiens
ttaatagcaaaaagatcaatatctactttcgactgggagaaaagaatgaaaaatgttaaa

SEQ ID NO: 1981 - DNA, 60 bp, Homo sapiens; identical to SEQ ID NO: 1980

SEQ ID NO: 1982 - DNA, 60 bp, Homo sapiens; identical to SEQ ID NO: 1084

SEQ ID NO: 1983 - DNA, 60 bp, Homo sapiens; identical to SEQ ID NO: 1084

SEQ ID NO: 1984 - DNA, 60 bp, Homo sapiens
taaatgtgagctacagtttatctacaaatcgattttttcattttaggttgtgaagactgt

SEQ ID NO: 1985 - DNA, 60 bp, Homo sapiens; identical to SEQ ID NO: 1984

SEQ ID NO: 1986 - DNA, 60 bp, Homo sapiens
tataaataccagagaagaagccatattttcgaaaatatttgacatagttgatcacttcct

SEQ ID NO: 1987 - DNA, 60 bp, Homo sapiens; identical to SEQ ID NO: 1986

SEQ ID NO: 1988 - DNA, 60 bp, Homo sapiens
tgttgtgaacttttgaaacaaatttgtttcgagatctataataaagcaaaggagagtctc

SEQ ID NO: 1989 - DNA, 60 bp, Homo sapiens; identical to SEQ ID NO: 1988

SEQ ID NO: 1990 - DNA, 60 bp, Homo sapiens
tataaataccagagaagaagccatattttcgaatcagtaatctttcttctgggaatctag

SEQ ID NO: 1991 - DNA, 60 bp, Homo sapiens; identical to SEQ ID NO: 1990

SEQ ID NO: 1992 - DNA, 60 bp, Homo sapiens
ctgtttcttacttctgaaacttacaatttcgaattatgtttctgtctcttcctttcctgt

SEQ ID NO: 1993 - DNA, 60 bp, Homo sapiens; identical to SEQ ID NO: 1992

SEQ ID NO: 1994 - DNA, 60 bp, Homo sapiens
ttagagaatgagaaagacatgtccttaatcgatataactctcaaattttgcctaaatgag

SEQ ID NO: 1995 - DNA, 60 bp, Homo sapiens; identical to SEQ ID NO: 1994

SEQ ID NO: 1996 - DNA, 60 bp, Homo sapiens
gttaacatagctaagtacctccgaaatatcgatgtcatattttatgtgtaatatatatgt

SEQ ID NO: 1997 - DNA, 60 bp, Homo sapiens; identical to SEQ ID NO: 1996

SEQ ID NO: 1998 - DNA, 60 bp, Homo sapiens
ttctcttctttattgcattaatctggtttcgatttcaccaagtttgcaaaagattctgtg

SEQ ID NO: 1999 - DNA, 60 bp, Homo sapiens; identical to SEQ ID NO: 1998

SEQ ID NO: 2000 - DNA, 60 bp, Homo sapiens
atttactcaaacttcctaagtgcttatttcgaaagttgatgccaaattgggaagtaagac

SEQ ID NO: 2001 - DNA, 60 bp, Homo sapiens; identical to SEQ ID NO: 2000

SEQ ID NO: 2002 - DNA, 60 bp, Homo sapiens
tctaaccattatgagtagatattaatcttcgagtggtgatatatttgaccagggaaataa

SEQ ID NO: 2003 - DNA, 60 bp, Homo sapiens; identical to SEQ ID NO: 2002

SEQ ID NO: 2004 - DNA, 60 bp, Homo sapiens
tacatttttagctcatcataaaagatattcgactctgggtttgacacacattagtttctt

SEQ ID NO: 2005 - DNA, 60 bp, Homo sapiens; identical to SEQ ID NO: 2004

SEQ ID NO: 2006 - DNA, 60 bp, Homo sapiens
atgtatttttcacaatatgaattaaaagtcgactgatacaactgacaggtagatagcatt

SEQ ID NO: 2007 - DNA, 60 bp, Homo sapiens; identical to SEQ ID NO: 2006

SEQ ID NO: 2008 - DNA, 60 bp, Homo sapiens
cagttttttaacaccactgttggtgatttcgatattaccttttttctggaaccatctttc

SEQ ID NO: 2009 - DNA, 60 bp, Homo sapiens; identical to SEQ ID NO: 2008

SEQ ID NO: 2010 - DNA, 60 bp, Homo sapiens
atgagaccaaattaccctttgaattctctcgaagcttgttttctttcacactcctagtgc

SEQ ID NO: 2011 - DNA, 60 bp, Homo sapiens; identical to SEQ ID NO: 2010

SEQ ID NO: 2012 - DNA, 60 bp, Homo sapiens
acagattaaaactatgaggatataccattcgacatctttcatatctgattctttttcctt

SEQ ID NO: 2013 - DNA, 60 bp, Homo sapiens; identical to SEQ ID NO: 2012

SEQ ID NO: 2014 - DNA, 24 bp, Homo sapiens
tcaaaacctgacataaatgcctca

SEQ ID NO: 2015 - DNA, 24 bp, Homo sapiens
tcaaaacctgacataaatgcctca

SEQ ID NO: 2016 - DNA, 26 bp, Homo sapiens
agcggtgtgcctgtgtctaatgaacg

SEQ ID NO: 2017 - DNA, 26 bp, Homo sapiens
agcggtgtgcctgtgtctaatgaacg

SEQ ID NO: 2018 - DNA, 26 bp, Homo sapiens
caggtgttaccagcatcctctcccta

SEQ ID NO: 2019 - DNA, 26 bp, Homo sapiens
caggtgttaccagcatcctctcccta

SEQ ID NO: 2020 - DNA, 26 bp, Homo sapiens
cactgctcggctttgtgttcaaggca

SEQ ID NO: 2021 - DNA, 26 bp, Homo sapiens
cactgctcggctttgtgttcaaggca

SEQ ID NO: 2022 - DNA, 26 bp, Homo sapiens
tgttatgttcattctctgtgccaggc

SEQ ID NO: 2023 - DNA, 26 bp, Homo sapiens
tgttatgttcattctctgtgccaggc

SEQ ID NO: 2024 - DNA, 26 bp, Homo sapiens
ggcaaaacaacttcccactgacctgt

SEQ ID NO: 2025 - DNA, 26 bp, Homo sapiens
ggcaaaacaacttcccactgacctgt

SEQ ID NO: 2026 - DNA, 26 bp, Homo sapiens
gctgatacctgaagcgtgagaaacag

SEQ ID NO: 2027 - DNA, 26 bp, Homo sapiens
gctgatacctgaagcgtgagaaacag

SEQ ID NO: 2028 - DNA, 26 bp, Homo sapiens
cccttcccactggttctaatgacatc

SEQ ID NO: 2029 - DNA, 26 bp, Homo sapiens
cccttcccactggttctaatgacatc

SEQ ID NO: 2030 - DNA, 24 bp, Homo sapiens
attttgtgtcactgtgctgttgtt

SEQ ID NO: 2031 - DNA, 24 bp, Homo sapiens
attttgtgtcactgtgctgttgtt

SEQ ID NO: 2032 - DNA, 23 bp, Homo sapiens
gcatcccacagttttcacaggta

SEQ ID NO: 2033 - DNA, 23 bp, Homo sapiens
gcatcccacagttttcacaggta

SEQ ID NO: 2034 - DNA, 26 bp, Homo sapiens
gtggtggtggttacataagggaaaac

SEQ ID NO: 2035 - DNA, 26 bp, Homo sapiens
gtggtggtggttacataagggaaaac

SEQ ID NO: 2036 - DNA, 26 bp, Homo sapiens
caaacaatgggacaccaagtagccct

SEQ ID NO: 2037 - DNA, 26 bp, Homo sapiens
caaacaatgggacaccaagtagccct

SEQ ID NO: 2038 - DNA, 23 bp, Homo sapiens
ggagaaggttccagaagccgcct

SEQ ID NO: 2039 - DNA, 23 bp, Homo sapiens
ggagaaggttccagaagccgcct

SEQ ID NO: 2040 - DNA, 23 bp, Homo sapiens
caaagtgctgggattacaggcat

SEQ ID NO: 2041 - DNA, 23 bp, Homo sapiens
caaagtgctgggattacaggcat

SEQ ID NO: 2042 - DNA, 24 bp, Homo sapiens
attgccagcatcactcttctttgc

SEQ ID NO: 2043 - DNA, 24 bp, Homo sapiens
attgccagcatcactcttctttgc

SEQ ID NO: 2044 - DNA, 26 bp, Homo sapiens
taactggattttctctggaatgaagc

SEQ ID NO: 2045 - DNA, 26 bp, Homo sapiens
taactggattttctctggaatgaagc

SEQ ID NO: 2046 - DNA, 23 bp, Homo sapiens
ggttctgagtgatgaaggcaagt

SEQ ID NO: 2047 - DNA, 23 bp, Homo sapiens
ggttctgagtgatgaaggcaagt

SEQ ID NO: 2048 - DNA, 26 bp, Homo sapiens
gggtgagtgggaagaatggtgctatt

SEQ ID NO: 2049 - DNA, 26 bp, Homo sapiens
gggtgagtgggaagaatggtgctatt

SEQ ID NO: 2050 - DNA, 24 bp, Homo sapiens
aatcacttcaacccaggaggtgga

SEQ ID NO: 2051 - DNA, 24 bp, Homo sapiens
aatcacttcaacccaggaggtgga

SEQ ID NO: 2052 - DNA, 24 bp, Homo sapiens
tattttacacggagtctgtggata

SEQ ID NO: 2053 - DNA, 24 bp, Homo sapiens
tattttacacggagtctgtggata

SEQ ID NO: 2054 - DNA, 26 bp, Homo sapiens
gctggtgtgccactaatgctctccaa

SEQ ID NO: 2055 - DNA, 26 bp, Homo sapiens
gctggtgtgccactaatgctctccaa

SEQ ID NO: 2056 - DNA, 23 bp, Homo sapiens
ctctccccaccattcctacctga

SEQ ID NO: 2057 - DNA, 23 bp, Homo sapiens
ctctccccaccattcctacctga

SEQ ID NO: 2058 - DNA, 23 bp, Homo sapiens
agcctgggcaatggagtgagact

SEQ ID NO: 2059 - DNA, 23 bp, Homo sapiens
agcctgggcaatggagtgagact

SEQ ID NO: 2060 - DNA, 26 bp, Homo sapiens
gttctccccttctgtcttttcacttt

SEQ ID NO: 2061 - DNA, 26 bp, Homo sapiens
gttctccccttctgtcttttcacttt

SEQ ID NO: 2062 - DNA, 24 bp, Homo sapiens
gataacattcacattttgaccagc

SEQ ID NO: 2063 - DNA, 24 bp, Homo sapiens
gataacattcacattttgaccagc

SEQ ID NO: 2064 - DNA, 21 bp, Homo sapiens
gccaaattttacctttacatt

SEQ ID NO: 2065 - DNA, 21 bp, Homo sapiens
gccaaattttacctttacatt

SEQ ID NO: 2066 - DNA, 23 bp, Homo sapiens
gctaaatccagactgccaccatt

SEQ ID NO: 2067 - DNA, 23 bp, Homo sapiens
gctaaatccagactgccaccatt

SEQ ID NO: 2068 - DNA, 26 bp, Homo sapiens
atgatttctacccttggtcagcaggt

SEQ ID NO: 2069 - DNA, 26 bp, Homo sapiens
atgatttctacccttggtcagcaggt

SEQ ID NO: 2070 - DNA, 23 bp, Homo sapiens
tccctgtgtttgagacccgccag

SEQ ID NO: 2071 - DNA, 23 bp, Homo sapiens
tccctgtgtttgagacccgccag

SEQ ID NO: 2072 - DNA, 23 bp, Homo sapiens
gaactgcttcttgcctcccttcc

SEQ ID NO: 2073 - DNA, 23 bp, Homo sapiens
gaactgcttcttgcctcccttcc

SEQ ID NO: 2074 - DNA, 23 bp, Homo sapiens
ctgagtgcctgggaatgacagtc

SEQ ID NO: 2075 - DNA, 23 bp, Homo sapiens
ctgagtgcctgggaatgacagtc

SEQ ID NO: 2076 - DNA, 26 bp, Homo sapiens
ctcaaacactggcaacgcattttccc

SEQ ID NO: 2077 - DNA, 26 bp, Homo sapiens
ctcaaacactggcaacgcattttccc

SEQ ID NO: 2078 - DNA, 26 bp, Homo sapiens
ctcagtttcctcaccaatcagactac

SEQ ID NO: 2079 - DNA, 26 bp, Homo sapiens
ctcagtttcctcaccaatcagactac

SEQ ID NO: 2080 - DNA, 23 bp, Homo sapiens
caggctgaggcactctggtctat

SEQ ID NO: 2081 - DNA, 23 bp, Homo sapiens
caggctgaggcactctggtctat

SEQ ID NO: 2082 - DNA, 24 bp, Homo sapiens
cttggcattttacttacttatctt

SEQ ID NO: 2083 - DNA, 24 bp, Homo sapiens
cttggcattttacttacttatctt

SEQ ID NO: 2084 - DNA, 26 bp, Homo sapiens
caaccaccatcactcgctgttttacc

SEQ ID NO: 2085 - DNA, 26 bp, Homo sapiens
caaccaccatcactcgctgttttacc

SEQ ID NO: 2086 - DNA, 26 bp, Homo sapiens
gccaccgcaactgctacacaactact

SEQ ID NO: 2087 - DNA, 26 bp, Homo sapiens
gccaccgcaactgctacacaactact

SEQ ID NO: 2088 - DNA, 23 bp, Homo sapiens
ctgacacgcctgccttcctcttt

SEQ ID NO: 2089 - DNA, 23 bp, Homo sapiens
ctgacacgcctgccttcctcttt

SEQ ID NO: 2090 - DNA, 26 bp, Homo sapiens
aagatgaagagagatgagggagaggc

SEQ ID NO: 2091 - DNA, 26 bp, Homo sapiens
aagatgaagagagatgagggagaggc

SEQ ID NO: 2092 - DNA, 24 bp, Homo sapiens
attgactaacaacaacaagaaagc

SEQ ID NO: 2093 - DNA, 24 bp, Homo sapiens
attgactaacaacaacaagaaagc

SEQ ID NO: 2094 - DNA, 26 bp, Homo sapiens
gaactgagcataatccttcttgtgac

SEQ ID NO: 2095 - DNA, 26 bp, Homo sapiens
gaactgagcataatccttcttgtgac

SEQ ID NO: 2096 - DNA, 26 bp, Homo sapiens
tgtgaagggcagtgaataaaggatta

SEQ ID NO: 2097 - DNA, 26 bp, Homo sapiens
tgtgaagggcagtgaataaaggatta

SEQ ID NO: 2098 - DNA, 24 bp, Homo sapiens
tgccattcacacaaagtctaaggg

SEQ ID NO: 2099 - DNA, 24 bp, Homo sapiens
tgccattcacacaaagtctaaggg

SEQ ID NO: 2100 - DNA, 26 bp, Homo sapiens
tgtgaagggcagtgaataaaggatta

SEQ ID NO: 2101 - DNA, 26 bp, Homo sapiens
tgtgaagggcagtgaataaaggatta

SEQ ID NO: 2102 - DNA, 26 bp, Homo sapiens
gaagccactctgattcccatcctttg

SEQ ID NO: 2103 - DNA, 26 bp, Homo sapiens
gaagccactctgattcccatcctttg

SEQ ID NO: 2104 - DNA, 24 bp, Homo sapiens
gcaggagggatgactacttgccaa

SEQ ID NO: 2105 - DNA, 24 bp, Homo sapiens
gcaggagggatgactacttgccaa

SEQ ID NO: 2106 - DNA, 24 bp, Homo sapiens
gaaataactgtcaaataagtcttc

SEQ ID NO: 2107 - DNA, 24 bp, Homo sapiens
gaaataactgtcaaataagtcttc

SEQ ID NO: 2108 - DNA, 26 bp, Homo sapiens
ctatttgcttccatctcttcttcaag

SEQ ID NO: 2109 - DNA, 26 bp, Homo sapiens
ctatttgcttccatctcttcttcaag

SEQ ID NO: 2110 - DNA, 25 bp, Homo sapiens
cctaagacagagggaaaagaaggta

SEQ ID NO: 2111 - DNA, 25 bp, Homo sapiens
cctaagacagagggaaaagaaggta

SEQ ID NO: 2112 - DNA, 23 bp, Homo sapiens
gccaaagactcctctgggaatcc

SEQ ID NO: 2113 - DNA, 23 bp, Homo sapiens
gccaaagactcctctgggaatcc

SEQ ID NO: 2114 - DNA, 26 bp, Homo sapiens
ttgtgctgtgtgaccttgggatgtcc

SEQ ID NO: 2115 - DNA, 26 bp, Homo sapiens
ttgtgctgtgtgaccttgggatgtcc

SEQ ID NO: 2116 - DNA, 23 bp, Homo sapiens
gaggcttccacagacagagaata

SEQ ID NO: 2117 - DNA, 23 bp, Homo sapiens
gaggcttccacagacagagaata

SEQ ID NO: 2118 - DNA, 26 bp, Homo sapiens
cctccaaacagtagcatcacatcacc

SEQ ID NO: 2119 - DNA, 26 bp, Homo sapiens
cctccaaacagtagcatcacatcacc

SEQ ID NO: 2120 - DNA, 23 bp, Homo sapiens
gccagcctctgtttgccaatggt

SEQ ID NO: 2121 - DNA, 23 bp, Homo sapiens
gccagcctctgtttgccaatggt

SEQ ID NO: 2122 - DNA, 24 bp, Homo sapiens
agcctgagcaacaagagcgaaact

SEQ ID NO: 2123 - DNA, 24 bp, Homo sapiens
agcctgagcaacaagagcgaaact

SEQ ID NO: 2124 - DNA, 24 bp, Homo sapiens
agccttgctgtttccatcgtgaat

SEQ ID NO: 2125 - DNA, 24 bp, Homo sapiens
agccttgctgtttccatcgtgaat

SEQ ID NO: 2126 - DNA, 26 bp, Homo sapiens
aaaccaagccaacaaggaacccattc

SEQ ID NO: 2127 - DNA, 26 bp, Homo sapiens
aaaccaagccaacaaggaacccattc

SEQ ID NO: 2128 - DNA, 26 bp, Homo sapiens
tgactggataacctcacagagtttcc

SEQ ID NO: 2129 - DNA, 26 bp, Homo sapiens
tgactggataacctcacagagtttcc

SEQ ID NO: 2130 - DNA, 26 bp, Homo sapiens
gacaactgaaccttccagcatcttga

SEQ ID NO: 2131 - DNA, 26 bp, Homo sapiens
gacaactgaaccttccagcatcttga

SEQ ID NO: 2132 - DNA, 26 bp, Homo sapiens
gcctctctccaaacaatcagggctct

SEQ ID NO: 2133 - DNA, 26 bp, Homo sapiens
gcctctctccaaacaatcagggctct

SEQ ID NO: 2134 - DNA, 26 bp, Homo sapiens
cgttgaccttcctacttatctaaaca

SEQ ID NO: 2135 - DNA, 26 bp, Homo sapiens
cgttgaccttcctacttatctaaaca

SEQ ID NO: 2136 - DNA, 26 bp, Homo sapiens
gcttgccactgacttgctaaaataac

SEQ ID NO: 2137 - DNA, 26 bp, Homo sapiens
gcttgccactgacttgctaaaataac

SEQ ID NO: 2138 - DNA, 26 bp, Homo sapiens
cctcctgaatgagacttccatagcag

SEQ ID NO: 2139 - DNA, 26 bp, Homo sapiens
cctcctgaatgagacttccatagcag

SEQ ID NO: 2140 - DNA, 24 bp, Homo sapiens
aaaggaaacgcttctacactgcta

SEQ ID NO: 2141 - DNA, 24 bp, Homo sapiens
aaaggaaacgcttctacactgcta

SEQ ID NO: 2142 - DNA, 26 bp, Homo sapiens
gccttatccatcttagtgttttcaga

SEQ ID NO: 2143 - DNA, 26 bp, Homo sapiens
gccttatccatcttagtgttttcaga

SEQ ID NO: 2144 - DNA, 26 bp, Homo sapiens
gcgagagagaagagaggcatccacat

SEQ ID NO: 2145 - DNA, 26 bp, Homo sapiens
gcgagagagaagagaggcatccacat

SEQ ID NO: 2146 - DNA, 26 bp, Homo sapiens
gctaagcattccaccactacagccta

SEQ ID NO: 2147 - DNA, 26 bp, Homo sapiens
gctaagcattccaccactacagccta

SEQ ID NO: 2148 - DNA, 23 bp, Homo sapiens
cccagaggagcaaacaaagagcc

SEQ ID NO: 2149 - DNA, 23 bp, Homo sapiens
cccagaggagcaaacaaagagcc

SEQ ID NO: 2150 - DNA, 26 bp, Homo sapiens
ctgactcaatcaaccacaaactaaag

SEQ ID NO: 2151 - DNA, 26 bp, Homo sapiens
ctgactcaatcaaccacaaactaaag

SEQ ID NO: 2152 - DNA, 23 bp, Homo sapiens
ctgccctgacttccctaaccctc

SEQ ID NO: 2153 - DNA, 23 bp, Homo sapiens
ctgccctgacttccctaaccctc

SEQ ID NO: 2154 - DNA, 26 bp, Homo sapiens
tgagacttccatagcagattaccttt

SEQ ID NO: 2155 - DNA, 26 bp, Homo sapiens
tgagacttccatagcagattaccttt

SEQ ID NO: 2156 - DNA, 25 bp, Homo sapiens
catttctcatcccaggcatttcaga

SEQ ID NO: 2157 - DNA, 25 bp, Homo sapiens
catttctcatcccaggcatttcaga

SEQ ID NO: 2158 - DNA, 26 bp, Homo sapiens
acctgagttcaaatccctctgctctc

SEQ ID NO: 2159 - DNA, 26 bp, Homo sapiens
acctgagttcaaatccctctgctctc

SEQ ID NO: 2160 - DNA, 24 bp, Homo sapiens
ccttatgctgttttatgttcctaa

SEQ ID NO: 2161 - DNA, 24 bp, Homo sapiens
ccttatgctgttttatgttcctaa

SEQ ID NO: 2162 - DNA, 24 bp, Homo sapiens
ataacactccattcacaaacttta

SEQ ID NO: 2163 - DNA, 24 bp, Homo sapiens
ataacactccattcacaaacttta

SEQ ID NO: 2164 - DNA, 26 bp, Homo sapiens
gtcacagcagcaatagaaatagcaac

SEQ ID NO: 2165 - DNA, 26 bp, Homo sapiens
gtcacagcagcaatagaaatagcaac

SEQ ID NO: 2166 - DNA, 23 bp, Homo sapiens
ggaggtgatggtgatgtgccagc

SEQ ID NO: 2167 - DNA, 23 bp, Homo sapiens
ggaggtgatggtgatgtgccagc

SEQ ID NO: 2168 - DNA, 23 bp, Homo sapiens
gagaagtcctgaagtaacgctac

SEQ ID NO: 2169 - DNA, 23 bp, Homo sapiens
gagaagtcctgaagtaacgctac

SEQ ID NO: 2170 - DNA, 26 bp, Homo sapiens
aggtggaccgagggacatttaccagt

SEQ ID NO: 2171 - DNA, 26 bp, Homo sapiens
aggtggaccgagggacatttaccagt

SEQ ID NO: 2172 - DNA, 25 bp, Homo sapiens
cttgtgaagtctttattattatgct

SEQ ID NO: 2173 - DNA, 25 bp, Homo sapiens
cttgtgaagtctttattattatgct

SEQ ID NO: 2174 - DNA, 21 bp, Homo sapiens
tgcattttatattgaaaagtt

SEQ ID NO: 2175 - DNA, 21 bp, Homo sapiens
tgcattttatattgaaaagtt

SEQ ID NO: 2176 - DNA, 26 bp, Homo sapiens
agtgtgcttggttgaactgaatcatt

SEQ ID NO: 2177 - DNA, 26 bp, Homo sapiens
agtgtgcttggttgaactgaatcatt

SEQ ID NO: 2178 - DNA, 26 bp, Homo sapiens
ggagggcataatctctgttctgctgc

SEQ ID NO: 2179 - DNA, 26 bp, Homo sapiens
ggagggcataatctctgttctgctgc

SEQ ID NO: 2180 - DNA, 23 bp, Homo sapiens
gccttctccccacacctggtatt

SEQ ID NO: 2181 - DNA, 23 bp, Homo sapiens
gccttctccccacacctggtatt

SEQ ID NO: 2182 - DNA, 23 bp, Homo sapiens
ccctaacctccccacacctcctt

SEQ ID NO: 2183 - DNA, 23 bp, Homo sapiens
ccctaacctccccacacctcctt

SEQ ID NO: 2184 - DNA, 23 bp, Homo sapiens
cagaatgggtccgtctcagaggc

SEQ ID NO: 2185 - DNA, 23 bp, Homo sapiens
cagaatgggtccgtctcagaggc

SEQ ID NO: 2186 - DNA, 26 bp, Homo sapiens
tttcagcatagattttgggcgaaggc

SEQ ID NO: 2187 - DNA, 26 bp, Homo sapiens
tttcagcatagattttgggcgaaggc

SEQ ID NO: 2188 - DNA, 26 bp, Homo sapiens
gcagatttggtgtgggttagagaggg

SEQ ID NO: 2189 - DNA, 26 bp, Homo sapiens
gcagatttggtgtgggttagagaggg

SEQ ID NO: 2190 - DNA, 23 bp, Homo sapiens
aaggagcgttgcggaatgggagc

SEQ ID NO: 2191 - DNA, 23 bp, Homo sapiens
aaggagcgttgcggaatgggagc

SEQ ID NO: 2192 - DNA, 24 bp, Homo sapiens
gtttgtgtccttccctctccctat

SEQ ID NO: 2193 - DNA, 24 bp, Homo sapiens
gtttgtgtccttccctctccctat

SEQ ID NO: 2194 - DNA, 26 bp, Homo sapiens
gcctgggctattagaaacagcatcag

SEQ ID NO: 2195 - DNA, 26 bp, Homo sapiens
gcctgggctattagaaacagcatcag

SEQ ID NO: 2196 - DNA, 26 bp, Homo sapiens
cttttgggagaccgtaggatttgtag

SEQ ID NO: 2197 - DNA, 26 bp, Homo sapiens
cttttgggagaccgtaggatttgtag

SEQ ID NO: 2198 - DNA, 23 bp, Homo sapiens
ccatctcctgcccgaagccagtt

SEQ ID NO: 2199 - DNA, 23 bp, Homo sapiens
ccatctcctgcccgaagccagtt

SEQ ID NO: 2200 - DNA, 26 bp, Homo sapiens
aaaataccaggcaggtgggaagaagg

SEQ ID NO: 2201 - DNA, 26 bp, Homo sapiens
aaaataccaggcaggtgggaagaagg

SEQ ID NO: 2202 - DNA, 24 bp, Homo sapiens
ttagatggatgaaagagatgaaaa

SEQ ID NO: 2203 - DNA, 24 bp, Homo sapiens
ttagatggatgaaagagatgaaaa

SEQ ID NO: 2204 - DNA, 26 bp, Homo sapiens
gatggtttcagatacctcccagatac

SEQ ID NO: 2205 - DNA, 26 bp, Homo sapiens
gatggtttcagatacctcccagatac

SEQ ID NO: 2206 - DNA, 24 bp, Homo sapiens
atggaaactgggagaggagacagc

SEQ ID NO: 2207 - DNA, 24 bp, Homo sapiens
atggaaactgggagaggagacagc

SEQ ID NO: 2208 - DNA, 24 bp, Homo sapiens
ttaccttactcattgaacagtttt

SEQ ID NO: 2209 - DNA, 24 bp, Homo sapiens
ttaccttactcattgaacagtttt

SEQ ID NO: 2210 - DNA, 26 bp, Homo sapiens
gggcattggaagttcaagcgactaac

SEQ ID NO: 2211 - DNA, 26 bp, Homo sapiens
gggcattggaagttcaagcgactaac

SEQ ID NO: 2212 - DNA, 24 bp, Homo sapiens
ccccaaatgcttcactctggaaag

SEQ ID NO: 2213 - DNA, 24 bp, Homo sapiens
ccccaaatgcttcactctggaaag

SEQ ID NO: 2214 - DNA, 26 bp, Homo sapiens
gtgctgcccaccatcactaaacaaat

SEQ ID NO: 2215 - DNA, 26 bp, Homo sapiens
gtgctgcccaccatcactaaacaaat

SEQ ID NO: 2216 - DNA, 24 bp, Homo sapiens
cacatctaacacttgacagcatta

SEQ ID NO: 2217 - DNA, 24 bp, Homo sapiens
cacatctaacacttgacagcatta

SEQ ID NO: 2218 - DNA, 26 bp, Homo sapiens
gctaccattctcttttggctttgagc

SEQ ID NO: 2219 - DNA, 26 bp, Homo sapiens
gctaccattctcttttggctttgagc

SEQ ID NO: 2220 - DNA, 25 bp, Homo sapiens
cggagcaagagcagtttggctgtgt

SEQ ID NO: 2221 - DNA, 25 bp, Homo sapiens
cggagcaagagcagtttggctgtgt

SEQ ID NO: 2222 - DNA, 23 bp, Homo sapiens
atagcagccagtctccacacccc

SEQ ID NO: 2223 - DNA, 23 bp, Homo sapiens
atagcagccagtctccacacccc

SEQ ID NO: 2224 - DNA, 25 bp, Homo sapiens
agggtggcaaatcaaacctacctga

SEQ ID NO: 2225 - DNA, 25 bp, Homo sapiens
agggtggcaaatcaaacctacctga

SEQ ID NO: 2226 - DNA, 24 bp, Homo sapiens
gccgtcccagtaataactaaatgc

SEQ ID NO: 2227 - DNA, 24 bp, Homo sapiens
gccgtcccagtaataactaaatgc

SEQ ID NO: 2228 - DNA, 26 bp, Homo sapiens
gggtatctcttgaactgatgactctt

SEQ ID NO: 2229 - DNA, 26 bp, Homo sapiens
gggtatctcttgaactgatgactctt

SEQ ID NO: 2230 - DNA, 23 bp, Homo sapiens
ccctctatgggtgctcagactgc

SEQ ID NO: 2231 - DNA, 23 bp, Homo sapiens
ccctctatgggtgctcagactgc

SEQ ID NO: 2232 - DNA, 24 bp, Homo sapiens
atggaaatgataagttgaaggtat

SEQ ID NO: 2233 - DNA, 24 bp, Homo sapiens
atggaaatgataagttgaaggtat

SEQ ID NO: 2234 - DNA, 60 bp, Homo sapiens
ctaagaacttgacaatttcataaggctttcgatgggcctagcttggctctaagcacttta

SEQ ID NO: 2235 - DNA, 60 bp, Homo sapiens; identical to SEQ ID NO: 2234

SEQ ID NO: 2236 - DNA, 60 bp, Homo sapiens
agcaaaaagtgaagactgcttgactttttcgaaaaaaaaaaaaaggaaaaatatcatgtc

SEQ ID NO: 2237 - DNA, 60 bp, Homo sapiens; identical to SEQ ID NO: 2236

SEQ ID NO: 2238 - DNA, 60 bp, Homo sapiens
gttaagtggtgtactttttgaaaatccatcgaacagaaattccttttcatattttcaaaa

SEQ ID NO: 2239 - DNA, 60 bp, Homo sapiens; identical to SEQ ID NO: 2238

SEQ ID NO: 2240 - DNA, 60 bp, Homo sapiens
ggaatgaataataaatttcctgtcattgtcgagaaaatatcttgtctgggccaggcctct

SEQ ID NO: 2241 - DNA, 60 bp, Homo sapiens; identical to SEQ ID NO: 2240

SEQ ID NO: 2242 - DNA, 60 bp, Homo sapiens
tgttttagtgccttcagcacatttattttcgattttagccccataaaactattttcagat

SEQ ID NO: 2243 - DNA, 60 bp, Homo sapiens; identical to SEQ ID NO: 2242

SEQ ID NO: 2244 - DNA, 60 bp, Homo sapiens
gacagatgtctgcaaagccatctactgctcgatggacaaagattgattgcatatcttggc

SEQ ID NO: 2245 - DNA, 60 bp, Homo sapiens; identical to SEQ ID NO: 2244

SEQ ID NO: 2246 - DNA, 60 bp, Homo sapiens
acctttcaaaaaatttctggcttatacatcgaaaaggagagggaatattttcttttgttg

SEQ ID NO: 2247 - DNA, 60 bp, Homo sapiens; identical to SEQ ID NO: 2246

SEQ ID NO: 2248 - DNA, 60 bp, Homo sapiens
gatgaaatgattttgctattgtcatacatcgatttttttttctttagtaacagaaaaaat

SEQ ID NO: 2249 - DNA, 60 bp, Homo sapiens; identical to SEQ ID NO: 2248

SEQ ID NO: 2250 - DNA, 60 bp, Homo sapiens
cagatgtctcccatataaataggaattatcgaataggaaattgttaggtaattaaggtag

SEQ ID NO: 2251 - DNA, 60 bp, Homo sapiens; identical to SEQ ID NO: 2250

SEQ ID NO: 2252 - DNA, 60 bp, Homo sapiens
gtgataatcctatttgtagtatagattatcgatagatgcagaaaaggtcttcaataaaat

SEQ ID NO: 2253 - DNA, 60 bp, Homo sapiens; identical to SEQ ID NO: 2252

SEQ ID NO: 2254 - DNA, 60 bp, Homo sapiens
aggaattaaaactgttgaaactttagtctcgagacaatagttttaaactaatgcatccat

SEQ ID NO: 2255 - DNA, 60 bp, Homo sapiens; identical to SEQ ID NO: 2254

SEQ ID NO: 2256 - DNA, 60 bp, Homo sapiens
attataacatctataaagaaaaataccctcgaaaaaaaaaaaatggaaaaaagaaaaaaa

SEQ ID NO: 2257 - DNA, 60 bp, Homo sapiens; identical to SEQ ID NO: 2256

SEQ ID NO: 2258 - DNA, 60 bp, Homo sapiens
ataaagagctcggaagtgagctctttagtcgaatgacaagcagtgagctaaaataaaggg

SEQ ID NO: 2259 - DNA, 60 bp, Homo sapiens; identical to SEQ ID NO: 2258

SEQ ID NO: 2260 - DNA, 60 bp, Homo sapiens
aacataccatataatctttataataaactcgaatgacattcatatgggcaaaaattatgc

SEQ ID NO: 2261 - DNA, 60 bp, Homo sapiens; identical to SEQ ID NO: 2260

SEQ ID NO: 2262 - DNA, 60 bp, Homo sapiens
tatcttctcttctttctccatgaaaaaatcgatgaggggatatttatttgttttgtaacc

SEQ ID NO: 2263 - DNA, 60 bp, Homo sapiens; identical to SEQ ID NO: 2262

SEQ ID NO: 2264 - DNA, 60 bp, Homo sapiens
gtagctgattcagtggtgtttataaagatcgagacatacttatgagcacctactatgtgc

SEQ ID NO: 2265 - DNA, 60 bp, Homo sapiens; identical to SEQ ID NO: 2264

SEQ ID NO: 2266 - DNA, 60 bp, Homo sapiens
ctttaagagtcgtttctggcaataaaaatcgaatttaatttgacattgatgtcactcttc

SEQ ID NO: 2267 - DNA, 60 bp, Homo sapiens; identical to SEQ ID NO: 2266

SEQ ID NO: 2268 - DNA, 60 bp, Homo sapiens
ttctcttctttattgcattaatctggtttcgattttctcttctctttataaaggtttttt

SEQ ID NO: 2269 - DNA, 60 bp, Homo sapiens; identical to SEQ ID NO: 2268

SEQ ID NO: 2270 - DNA, 60 bp, Homo sapiens
attattgctgttattgttattcttgctatcgatggaacagaaaaagaatgcaaagagaca

SEQ ID NO: 2271 - DNA, 60 bp, Homo sapiens; identical to SEQ ID NO: 2270

SEQ ID NO: 2272 - DNA, 60 bp, Homo sapiens
ctcattatactgagtttatttgttttattcgacctctcactgaagcttccagctcatttc

SEQ ID NO: 2273 - DNA, 60 bp, Homo sapiens; identical to SEQ ID NO: 2272

SEQ ID NO: 2274 - DNA, 60 bp, Homo sapiens
acctatattaaagaaaaagagaaacgactcgactctgtctcaaaaaaataaataaaataa

SEQ ID NO: 2275 - DNA, 60 bp, Homo sapiens; identical to SEQ ID NO: 2274

SEQ ID NO: 2276 - DNA, 60 bp, Homo sapiens
cagaaggatctcatcatttaaaaaaatctcgaaaagcttttctaccacttcccagtaaat

SEQ ID NO: 2277 - DNA, 60 bp, Homo sapiens; identical to SEQ ID NO: 2276

SEQ ID NO: 2278 - DNA, 60 bp, Homo sapiens
tgttctttcttcatttaatgtataaccatcgacttcagtaactgaaaagatgttttgaac

SEQ ID NO: 2279 - DNA, 60 bp, Homo sapiens; identical to SEQ ID NO: 2278

SEQ ID NO: 2280 - DNA, 60 bp, Homo sapiens
gacagtgttttggaaattgaaattactttcgatgtagggttgctacaaactgtctatttg

SEQ ID NO: 2281 - DNA, 60 bp, Homo sapiens; identical to SEQ ID NO: 2280

SEQ ID NO: 2282 - DNA, 60 bp, Homo sapiens
ctttatgataattgctatgttagtagcctcgagactcagagaggttaaataacttctcca

SEQ ID NO: 2283 - DNA, 60 bp, Homo sapiens; identical to SEQ ID NO: 2282

SEQ ID NO: 2284 - DNA, 60 bp, Homo sapiens
gccttcaaatcatcaccgttaatccttttcgaaacacttgaccagctctctcatttatct

SEQ ID NO: 2285 - DNA, 60 bp, Homo sapiens; identical to SEQ ID NO: 2284

SEQ ID NO: 2286 - DNA, 60 bp, Homo sapiens
cctaccagaactcttaaatctataatattcgactaactcctccgtaaagaatagctacca

SEQ ID NO: 2287 - DNA, 60 bp, Homo sapiens; identical to SEQ ID NO: 2286

SEQ ID NO: 2288 - DNA, 60 bp, Homo sapiens
taaagaaatttaaatttaaaatgtatgctcgatactctgttttccaggcatgtctgcaga

SEQ ID NO: 2289 - DNA, 60 bp, Homo sapiens; identical to SEQ ID NO: 2288

SEQ ID NO: 2290 - DNA, 60 bp, Homo sapiens
ttccaaaattctgagattcttaattatgtcgaatttgtctaaggtttttcttttaacacc

SEQ ID NO: 2291 - DNA, 60 bp, Homo sapiens; identical to SEQ ID NO: 2290

SEQ ID NO: 2292 - DNA, 60 bp, Homo sapiens
gagaggaagcctgtcttttccaggcttctcgaaaggtaaggcagagtgagatggaatcta

SEQ ID NO: 2293 - DNA, 60 bp, Homo sapiens; identical to SEQ ID NO: 2292

SEQ ID NO: 2294 - DNA, 60 bp, Homo sapiens
ttttaaatcaataacattttagggtaagtcgattcctgactcttttttctgtggttgtga

SEQ ID NO: 2295 - DNA, 60 bp, Homo sapiens; identical to SEQ ID NO: 2294

SEQ ID NO: 2296 - DNA, 60 bp, Homo sapiens
aaatactacctagtaaacccttattatctcgatatattatcaatatattttttcccatca

SEQ ID NO: 2297 - DNA, 60 bp, Homo sapiens; identical to SEQ ID NO: 2296

SEQ ID NO: 2298 - DNA, 60 bp, Homo sapiens
gcttcttttcttttttttttatattacttcgaaggtggaacttaaccctccccttaagaa

SEQ ID NO: 2299 - DNA, 60 bp, Homo sapiens; identical to SEQ ID NO: 2298

SEQ ID NO: 2300 - DNA, 60 bp, Homo sapiens
gaccacaaagtgaaggtaaaaataaaattcgagaattcaatacatcatgattctttttta

SEQ ID NO: 2301 - DNA, 60 bp, Homo sapiens; identical to SEQ ID NO: 2300

SEQ ID NO: 2302 - DNA, 60 bp, Homo sapiens
cccgattacttcagatttacttacagcctcgagacttctttttataaccaaataatttta

SEQ ID NO: 2303 - DNA, 60 bp, Homo sapiens; identical to SEQ ID NO: 2302

SEQ ID NO: 2304 - DNA, 60 bp, Homo sapiens
cttttaacagatcacaatatcaaaaatctcgaatgtcaactgttctggttttcatgtgaa

SEQ ID NO: 2305 - DNA, 60 bp, Homo sapiens; identical to SEQ ID NO: 2304

SEQ ID NO: 2306 - DNA, 60 bp, Homo sapiens
gaataaacatgtgcatagacaaccattatcgattaaaggaagatatctgagtacaagctg

SEQ ID NO: 2307 - DNA, 60 bp, Homo sapiens; identical to SEQ ID NO: 2306

SEQ ID NO: 2308 - DNA, 60 bp, Homo sapiens
gtctatcagttatctgttaagttttgaatcgagcagaatacagccatatttttcttcttg

SEQ ID NO: 2309 - DNA, 60 bp, Homo sapiens; identical to SEQ ID NO: 2308

SEQ ID NO: 2310 - DNA, 60 bp, Homo sapiens
aaaataagttgatagaggaaagtattattcgaagcttgctggaattgtgagaaaagtaag

SEQ ID NO: 2311 - DNA, 60 bp, Homo sapiens; identical to SEQ ID NO: 2310

SEQ ID NO: 2312 - DNA, 60 bp, Homo sapiens
tgttacaactgaatttgttgcatttttctcgaaccaccctacatgaaaatgggaaaaaca

SEQ ID NO: 2313 - DNA, 60 bp, Homo sapiens; identical to SEQ ID NO: 2312

SEQ ID NO: 2314 - DNA, 60 bp, Homo sapiens
tgctcttttaggatagcttgaagtaatttcgatttccccattcctaatccttaaataatg

SEQ ID NO: 2315 - DNA, 60 bp, Homo sapiens; identical to SEQ ID NO: 2314

SEQ ID NO: 2316 - DNA, 60 bp, Homo sapiens
cagtattaggttactgatttctgatttttcgaatgatctaaaaaaaaaaaaagttagacc

SEQ ID NO: 2317 - DNA, 60 bp, Homo sapiens; identical to SEQ ID NO: 2316

SEQ ID NO: 2318 - DNA, 60 bp, Homo sapiens
gcaattcatatagtctaaaaaattttaatcgaggaagattaagtgacctgataaagtgga

SEQ ID NO: 2319 - DNA, 60 bp, Homo sapiens; identical to SEQ ID NO: 2318

SEQ ID NO: 2320 - DNA, 60 bp, Homo sapiens
tttttaaagaaggtttgtatcatatttctcgaagagtggcatgcttttcccaaatgtcac

SEQ ID NO: 2321 - DNA, 60 bp, Homo sapiens; identical to SEQ ID NO: 2320

SEQ ID NO: 2322 - DNA, 60 bp, Homo sapiens
agattttttttttttaaaatgatttcaatcgagagagtgtttaaatccagagatttgtga

SEQ ID NO: 2323 - DNA, 60 bp, Homo sapiens; identical to SEQ ID NO: 2322

SEQ ID NO: 2324 - DNA, 60 bp, Homo sapiens
ttgactcttttgaacctcttgagacttgtcgaagcagtctaattttaggtttaaaagaat

SEQ ID NO: 2325 - DNA, 60 bp, Homo sapiens; identical to SEQ ID NO: 2324

SEQ ID NO: 2326 - DNA, 60 bp, Homo sapiens
atatatgacctaacctattaaaaagagatcgattgataataaaatttgtcattttctcag

SEQ ID NO: 2327 - DNA, 60 bp, Homo sapiens; identical to SEQ ID NO: 2326

SEQ ID NO: 2328 - DNA, 60 bp, Homo sapiens
acttaatttaacataattattaaattgatcgacctacccatcttttaaaatctttctgtc

SEQ ID NO: 2329 - DNA, 60 bp, Homo sapiens; identical to SEQ ID NO: 2328

SEQ ID NO: 2330 - DNA, 60 bp, Homo sapiens
ttttggttgaaatgtataccaacaattttcgaacagaatacatagaaagtaccaagagaa

SEQ ID NO: 2331 - DNA, 60 bp, Homo sapiens; identical to SEQ ID NO: 2330

SEQ ID NO: 2332 - DNA, 60 bp, Homo sapiens
tttaaaatgctttaaaattgtttaaatatcgactctaggatgccataccataagcatctt

SEQ ID NO: 2333 - DNA, 60 bp, Homo sapiens; identical to SEQ ID NO: 2332

SEQ ID NO: 2334 - DNA, 60 bp, Homo sapiens
cagtaatcctagaaagacaactgatacatcgaattccaactctcatcacagtagcagcac

SEQ ID NO: 2335 - DNA, 60 bp, Homo sapiens; identical to SEQ ID NO: 2334

SEQ ID NO: 2336 - DNA, 60 bp, Homo sapiens
tttcagagaagtattaactacagacatttcgaagacgttatccctgtaaattacctctac

SEQ ID NO: 2337 - DNA, 60 bp, Homo sapiens; identical to SEQ ID NO: 2336

SEQ ID NO: 2338 - DNA, 60 bp, Homo sapiens
gttagaaactgtttttcacaattaagtttcgaatattacttttattccccccaccaaact

SEQ ID NO: 2339 - DNA, 60 bp, Homo sapiens; identical to SEQ ID NO: 2338

SEQ ID NO: 2340 - DNA, 60 bp, Homo sapiens
ctccttcaacctggtggatccaccagtttcgacatctttaaccaattacatctgtaagaa

SEQ ID NO: 2341 - DNA, 60 bp, Homo sapiens; identical to SEQ ID NO: 2340

SEQ ID NO: 2342 - DNA, 60 bp, Homo sapiens
cagcttgtactcagatatcttcctttaatcgattggtgagatttttaagttcaaaatgta

SEQ ID NO: 2343 - DNA, 60 bp, Homo sapiens; identical to SEQ ID NO: 2342

SEQ ID NO: 2344 - DNA, 24 bp, Homo sapiens
gttagtatgtattttctgtggata

SEQ ID NO: 2345 - DNA, 24 bp, Homo sapiens
gttagtatgtattttctgtggata

SEQ ID NO: 2346 - DNA, 26 bp, Homo sapiens
gaagcctggattggaagcagatttgc

SEQ ID NO: 2347 - DNA, 26 bp, Homo sapiens
gaagcctggattggaagcagatttgc

SEQ ID NO: 2348 - DNA, 23 bp, Homo sapiens
gggacattgaggtgttggtggca

SEQ ID NO: 2349 - DNA, 23 bp, Homo sapiens
gggacattgaggtgttggtggca

SEQ ID NO: 2350 - DNA, 26 bp, Homo sapiens
tccctcggagcatagaactcatcttc

SEQ ID NO: 2351 - DNA, 26 bp, Homo sapiens
tccctcggagcatagaactcatcttc

SEQ ID NO: 2352 - DNA, 26 bp, Homo sapiens
agtgtttggtgtccagcaagcagtgc

SEQ ID NO: 2353 - DNA, 26 bp, Homo sapiens
agtgtttggtgtccagcaagcagtgc

SEQ ID NO: 2354 - DNA, 24 bp, Homo sapiens
atgatgccttcctatgtgcctggc

SEQ ID NO: 2355 - DNA, 24 bp, Homo sapiens
atgatgccttcctatgtgcctggc

SEQ ID NO: 2356 - DNA, 26 bp, Homo sapiens
gaggaagggaaacagtcaagaggtat

SEQ ID NO: 2357 - DNA, 26 bp, Homo sapiens
gaggaagggaaacagtcaagaggtat

SEQ ID NO: 2358 - DNA, 26 bp, Homo sapiens
agaggtttagagtttggaacatttgc

SEQ ID NO: 2359 - DNA, 26 bp, Homo sapiens
agaggtttagagtttggaacatttgc

SEQ ID NO: 2360 - DNA, 26 bp, Homo sapiens
gcagagttgccaatcacagtatttat

SEQ ID NO: 2361 - DNA, 26 bp, Homo sapiens
gcagagttgccaatcacagtatttat

SEQ ID NO: 2362 - DNA, 24 bp, Homo sapiens
cagagcaaatgagtcaactgaaaa

SEQ ID NO: 2363 - DNA, 24 bp, Homo sapiens
cagagcaaatgagtcaactgaaaa

SEQ ID NO: 2364 - DNA, 26 bp, Homo sapiens
gaaggtaaatctcatagcaggctggg

SEQ ID NO: 2365 - DNA, 26 bp, Homo sapiens
gaaggtaaatctcatagcaggctggg

SEQ ID NO: 2366 - DNA, 24 bp, Homo sapiens
tgtgaaataatcagtcttggaaat

SEQ ID NO: 2367 - DNA, 24 bp, Homo sapiens
tgtgaaataatcagtcttggaaat

SEQ ID NO: 2368 - DNA, 24 bp, Homo sapiens
attgcttgaatctggaaggcggag

SEQ ID NO: 2369 - DNA, 24 bp, Homo sapiens
attgcttgaatctggaaggcggag

SEQ ID NO: 2370 - DNA, 26 bp, Homo sapiens
gagggaggatgtcactgttggttcca

SEQ ID NO: 2371 - DNA, 26 bp, Homo sapiens
gagggaggatgtcactgttggttcca

SEQ ID NO: 2372 - DNA, 26 bp, Homo sapiens
tgctgtgcttgaaggaaggatggtgt

SEQ ID NO: 2373 - DNA, 26 bp, Homo sapiens
tgctgtgcttgaaggaaggatggtgt

SEQ ID NO: 2374 - DNA, 23 bp, Homo sapiens
cctccttttgcctccgattcctc

SEQ ID NO: 2375 - DNA, 23 bp, Homo sapiens
cctccttttgcctccgattcctc

SEQ ID NO: 2376 - DNA, 26 bp, Homo sapiens
cttggcataaagcagggctccaggaa

SEQ ID NO: 2377 - DNA, 26 bp, Homo sapiens
cttggcataaagcagggctccaggaa

SEQ ID NO: 2378 - DNA, 26 bp, Homo sapiens
ctatttgcttccatctcttcttcaag

SEQ ID NO: 2379 - DNA, 26 bp, Homo sapiens
ctatttgcttccatctcttcttcaag

SEQ ID NO: 2380 - DNA, 26 bp, Homo sapiens
ctaacacaatggtagacacatagcaa

SEQ ID NO: 2381 - DNA, 26 bp, Homo sapiens
ctaacacaatggtagacacatagcaa

SEQ ID NO: 2382 - DNA, 26 bp, Homo sapiens
atggagttcccagacttagcaaataa

SEQ ID NO: 2383 - DNA, 26 bp, Homo sapiens
atggagttcccagacttagcaaataa

SEQ ID NO: 2384 - DNA, 26 bp, Homo sapiens
gagaaaaggtgggtagggagtagagc

SEQ ID NO: 2385 - DNA, 26 bp, Homo sapiens
gagaaaaggtgggtagggagtagagc

SEQ ID NO: 2386 - DNA, 26 bp, Homo sapiens
taacttacaggtcccacagattagga

SEQ ID NO: 2387 - DNA, 26 bp, Homo sapiens
taacttacaggtcccacagattagga

SEQ ID NO: 2388 - DNA, 26 bp, Homo sapiens
ctaaatcctgagtgtctttccatcca

SEQ ID NO: 2389 - DNA, 26 bp, Homo sapiens
ctaaatcctgagtgtctttccatcca

SEQ ID NO: 2390 - DNA, 26 bp, Homo sapiens
ggaagtggattatggagccaggaaac

SEQ ID NO: 2391 - DNA, 26 bp, Homo sapiens
ggaagtggattatggagccaggaaac

SEQ ID NO: 2392 - DNA, 26 bp, Homo sapiens
cacacataatccagagtcagggagag

SEQ ID NO: 2393 - DNA, 26 bp, Homo sapiens
cacacataatccagagtcagggagag

SEQ ID NO: 2394 - DNA, 26 bp, Homo sapiens
tttctcctactttggatttgttgagc

SEQ ID NO: 2395 - DNA, 26 bp, Homo sapiens
tttctcctactttggatttgttgagc

SEQ ID NO: 2396 - DNA, 26 bp, Homo sapiens
cttacagccttccaaaataactccag

SEQ ID NO: 2397 - DNA, 26 bp, Homo sapiens
cttacagccttccaaaataactccag

SEQ ID NO: 2398 - DNA, 24 bp, Homo sapiens
tagttagttacccatctgtttcta

SEQ ID NO: 2399 - DNA, 24 bp, Homo sapiens
tagttagttacccatctgtttcta

SEQ ID NO: 2400 - DNA, 23 bp, Homo sapiens
ccactcagcctcacagagcctca

SEQ ID NO: 2401 - DNA, 23 bp, Homo sapiens
ccactcagcctcacagagcctca

SEQ ID NO: 2402 - DNA, 26 bp, Homo sapiens
cctttatctcaaactcctccagtagg

SEQ ID NO: 2403 - DNA, 26 bp, Homo sapiens
cctttatctcaaactcctccagtagg

SEQ ID NO: 2404 - DNA, 26 bp, Homo sapiens
ctgaacctgtttgtaagttgagggtg

SEQ ID NO: 2405 - DNA, 26 bp, Homo sapiens
ctgaacctgtttgtaagttgagggtg

SEQ ID NO: 2406 - DNA, 26 bp, Homo sapiens
ctatgctcaagagaactaaagtagga

SEQ ID NO: 2407 - DNA, 26 bp, Homo sapiens
ctatgctcaagagaactaaagtagga

SEQ ID NO: 2408 - DNA, 26 bp, Homo sapiens
caagataccagtgttaggttgtgaaa

SEQ ID NO: 2409 - DNA, 26 bp, Homo sapiens
caagataccagtgttaggttgtgaaa

SEQ ID NO: 2410 - DNA, 23 bp, Homo sapiens
gtctgggaggcatttggagcatc

SEQ ID NO: 2411 - DNA, 23 bp, Homo sapiens
gtctgggaggcatttggagcatc

SEQ ID NO: 2412 - DNA, 26 bp, Homo sapiens
gcttatttcctgaacgcacttgccta

SEQ ID NO: 2413 - DNA, 26 bp, Homo sapiens
gcttatttcctgaacgcacttgccta

SEQ ID NO: 2414 - DNA, 23 bp, Homo sapiens
gccagtccaaggtgctgtggtag

SEQ ID NO: 2415 - DNA, 23 bp, Homo sapiens
gccagtccaaggtgctgtggtag

SEQ ID NO: 2416 - DNA, 24 bp, Homo sapiens
atctatgcctgccacaaagtaggg

SEQ ID NO: 2417 - DNA, 24 bp, Homo sapiens
atctatgcctgccacaaagtaggg

SEQ ID NO: 2418 - DNA, 24 bp, Homo sapiens
tgatgaggttgtaatgttatttca

SEQ ID NO: 2419 - DNA, 24 bp, Homo sapiens
tgatgaggttgtaatgttatttca

SEQ ID NO: 2420 - DNA, 26 bp, Homo sapiens
gaagaataatgaaacctcctggaagg

SEQ ID NO: 2421 - DNA, 26 bp, Homo sapiens
gaagaataatgaaacctcctggaagg

SEQ ID NO: 2422 - DNA, 26 bp, Homo sapiens
tagtgcctgaggagacatcttacagc

SEQ ID NO: 2423 - DNA, 26 bp, Homo sapiens
tagtgcctgaggagacatcttacagc

SEQ ID NO: 2424 - DNA, 26 bp, Homo sapiens
ggcagaagcagaacttggctcttatt

SEQ ID NO: 2425 - DNA, 26 bp, Homo sapiens
ggcagaagcagaacttggctcttatt

SEQ ID NO: 2426 - DNA, 26 bp, Homo sapiens
ggtgagcgtagttgttcataatagtc

SEQ ID NO: 2427 - DNA, 26 bp, Homo sapiens
ggtgagcgtagttgttcataatagtc

SEQ ID NO: 2428 - DNA, 24 bp, Homo sapiens
tccaggtatctacttttcttctat

SEQ ID NO: 2429 - DNA, 24 bp, Homo sapiens
tccaggtatctacttttcttctat

SEQ ID NO: 2430 - DNA, 23 bp, Homo sapiens
ggtctgaacacagtcttggctgg

SEQ ID NO: 2431 - DNA, 23 bp, Homo sapiens
ggtctgaacacagtcttggctgg

SEQ ID NO: 2432 - DNA, 23 bp, Homo sapiens
cccaggtctccaggtctccttag

SEQ ID NO: 2433 - DNA, 23 bp, Homo sapiens
cccaggtctccaggtctccttag

SEQ ID NO: 2434 - DNA, 25 bp, Homo sapiens
gcctgttgcggttctttctgttgaa

SEQ ID NO: 2435 - DNA, 25 bp, Homo sapiens
gcctgttgcggttctttctgttgaa

SEQ ID NO: 2436 - DNA, 26 bp, Homo sapiens
gaaactggaaaactttagagaagagc

SEQ ID NO: 2437 - DNA, 26 bp, Homo sapiens
gaaactggaaaactttagagaagagc

SEQ ID NO: 2438 - DNA, 26 bp, Homo sapiens
cttggcgatttgtatgagtaggttgc

SEQ ID NO: 2439 - DNA, 26 bp, Homo sapiens
cttggcgatttgtatgagtaggttgc

SEQ ID NO: 2440 - DNA, 26 bp, Homo sapiens
ggcaaaacaaatacttcctgggcatt

SEQ ID NO: 2441 - DNA, 26 bp, Homo sapiens
ggcaaaacaaatacttcctgggcatt

SEQ ID NO: 2442 - DNA, 26 bp, Homo sapiens
agtgagataatgtgcctgaaagcaat

SEQ ID NO: 2443 - DNA, 26 bp, Homo sapiens
agtgagataatgtgcctgaaagcaat

SEQ ID NO: 2444 - DNA, 26 bp, Homo sapiens
cgggaggtttctgtgagaggtgttct

SEQ ID NO: 2445 - DNA, 26 bp, Homo sapiens
cgggaggtttctgtgagaggtgttct

SEQ ID NO: 2446 - DNA, 23 bp, Homo sapiens
tcccaagggcacctgctcacaag

SEQ ID NO: 2447 - DNA, 23 bp, Homo sapiens
tcccaagggcacctgctcacaag

SEQ ID NO: 2448 - DNA, 23 bp, Homo sapiens
gggagaatgaggaatgaggaccg

SEQ ID NO: 2449 - DNA, 23 bp, Homo sapiens
gggagaatgaggaatgaggaccg

SEQ ID NO: 2450 - DNA, 24 bp, Homo sapiens
atcatcagaggattactcagaggg

SEQ ID NO: 2451 - DNA, 24 bp, Homo sapiens
atcatcagaggattactcagaggg

SEQ ID NO: 2452 - DNA, 24 bp, Homo sapiens
ctctttctgaggcttttgttcata

SEQ ID NO: 2453 - DNA, 24 bp, Homo sapiens
ctctttctgaggcttttgttcata

SEQ ID NO: 2454 - DNA, 25 bp, Homo sapiens
gtattttgttatcttacctaatgga

SEQ ID NO: 2455 - DNA, 25 bp, Homo sapiens
gtattttgttatcttacctaatgga

SEQ ID NO: 2456 - DNA, 26 bp, Homo sapiens
ctattgctatgtcttcaagttcaacc

SEQ ID NO: 2457 - DNA, 26 bp, Homo sapiens
ctattgctatgtcttcaagttcaacc

SEQ ID NO: 2458 - DNA, 23 bp, Homo sapiens
gaagtcccctggcgaagatgagc

SEQ ID NO: 2459 - DNA, 23 bp, Homo sapiens
gaagtcccctggcgaagatgagc

SEQ ID NO: 2460 - DNA, 26 bp, Homo sapiens
ggctctgacataactccacaagggta

SEQ ID NO: 2461 - DNA, 26 bp, Homo sapiens
ggctctgacataactccacaagggta

SEQ ID NO: 2462 - DNA, 26 bp, Homo sapiens
ggtcggattctggctacattttgaag

SEQ ID NO: 2463 - DNA, 26 bp, Homo sapiens
ggtcggattctggctacattttgaag

SEQ ID NO: 2464 - DNA, 26 bp, Homo sapiens
gtgtgtagtcagtcaatgggaaggaa

SEQ ID NO: 2465 - DNA, 26 bp, Homo sapiens
gtgtgtagtcagtcaatgggaaggaa

SEQ ID NO: 2466 - DNA, 26 bp, Homo sapiens
gacctgtttccctcccaagagcctat

SEQ ID NO: 2467 - DNA, 26 bp, Homo sapiens
gacctgtttccctcccaagagcctat

SEQ ID NO: 2468 - DNA, 23 bp, Homo sapiens
cactttgttgcctgagttgccta

SEQ ID NO: 2469 - DNA, 23 bp, Homo sapiens
cactttgttgcctgagttgccta

SEQ ID NO: 2470 - DNA, 26 bp, Homo sapiens
ccaatggctcccaacttcccactaat

SEQ ID NO: 2471 - DNA, 26 bp, Homo sapiens
ccaatggctcccaacttcccactaat

SEQ ID NO: 2472 - DNA, 25 bp, Homo sapiens
caagtaactcttattattttgaggt

SEQ ID NO: 2473 - DNA, 25 bp, Homo sapiens
caagtaactcttattattttgaggt

SEQ ID NO: 2474 - DNA, 26 bp, Homo sapiens
cataaaagcagaacaggagcacattc

SEQ ID NO: 2475 - DNA, 26 bp, Homo sapiens
cataaaagcagaacaggagcacattc

SEQ ID NO: 2476 - DNA, 24 bp, Homo sapiens
ccaaagtgctgggattacaggcat

SEQ ID NO: 2477 - DNA, 24 bp, Homo sapiens
ccaaagtgctgggattacaggcat

SEQ ID NO: 2478 - DNA, 24 bp, Homo sapiens
ttttctcccagtgattattatgta

SEQ ID NO: 2479 - DNA, 24 bp, Homo sapiens
ttttctcccagtgattattatgta

SEQ ID NO: 2480 - DNA, 26 bp, Homo sapiens
aatcctctcttgactgacctggcata

SEQ ID NO: 2481 - DNA, 26 bp, Homo sapiens
aatcctctcttgactgacctggcata

SEQ ID NO: 2482 - DNA, 23 bp, Homo sapiens
taggctgtttcagtgacccagaa

SEQ ID NO: 2483 - DNA, 23 bp, Homo sapiens
taggctgtttcagtgacccagaa

SEQ ID NO: 2484 - DNA, 23 bp, Homo sapiens
tatctttggtgccagccccgtgc

SEQ ID NO: 2485 - DNA, 23 bp, Homo sapiens
tatctttggtgccagccccgtgc

SEQ ID NO: 2486 - DNA, 26 bp, Homo sapiens
aactcctttactgctttgaccaccat

SEQ ID NO: 2487 - DNA, 26 bp, Homo sapiens
aactcctttactgctttgaccaccat

SEQ ID NO: 2488 - DNA, 26 bp, Homo sapiens
tggctatgaagggcaggagaggaata

SEQ ID NO: 2489 - DNA, 26 bp, Homo sapiens
tggctatgaagggcaggagaggaata

SEQ ID NO: 2490 - DNA, 26 bp, Homo sapiens
cctgttgaatgactaactggatgaga

SEQ ID NO: 2491 - DNA, 26 bp, Homo sapiens
cctgttgaatgactaactggatgaga

SEQ ID NO: 2492 - DNA, 26 bp, Homo sapiens
gtagtcaggcaaagagagtagggcat

SEQ ID NO: 2493 - DNA, 26 bp, Homo sapiens
gtagtcaggcaaagagagtagggcat

SEQ ID NO: 2494 - DNA, 26 bp, Homo sapiens
ccctgtattcttaggcaccaagtctt

SEQ ID NO: 2495 - DNA, 26 bp, Homo sapiens
ccctgtattcttaggcaccaagtctt

SEQ ID NO: 2496 - DNA, 26 bp, Homo sapiens
cttactttgctcaatcagttcctctg

SEQ ID NO: 2497 - DNA, 26 bp, Homo sapiens
cttactttgctcaatcagttcctctg

SEQ ID NO: 2498 - DNA, 26 bp, Homo sapiens
ccctctccaaacctccttctctcaag

SEQ ID NO: 2499 - DNA, 26 bp, Homo sapiens
ccctctccaaacctccttctctcaag

SEQ ID NO: 2500 - DNA, 26 bp, Homo sapiens
gctttacctgtgttaccactctatgc

SEQ ID NO: 2501 - DNA, 26 bp, Homo sapiens
gctttacctgtgttaccactctatgc

SEQ ID NO: 2502 - DNA, 26 bp, Homo sapiens
tgggtttggtagggctttattccagc

SEQ ID NO: 2503 - DNA, 26 bp, Homo sapiens
tgggtttggtagggctttattccagc

SEQ ID NO: 2504 - DNA, 26 bp, Homo sapiens
ggaggaggttcacactacgggataaa

SEQ ID NO: 2505 - DNA, 26 bp, Homo sapiens
ggaggaggttcacactacgggataaa

SEQ ID NO: 2506 - DNA, 26 bp, Homo sapiens
atggcattccctgatttccctggatg

SEQ ID NO: 2507 - DNA, 26 bp, Homo sapiens
atggcattccctgatttccctggatg

SEQ ID NO: 2508 - DNA, 24 bp, Homo sapiens
gaacaccctaaacgagcaggagat

SEQ ID NO: 2509 - DNA, 24 bp, Homo sapiens
gaacaccctaaacgagcaggagat

SEQ ID NO: 2510 - DNA, 23 bp, Homo sapiens
ccacttccatccccttcaccact

SEQ ID NO: 2511 - DNA, 23 bp, Homo sapiens
ccacttccatccccttcaccact

SEQ ID NO: 2512 - DNA, 26 bp, Homo sapiens
gagaaaggagagggaaaacagtgggc

SEQ ID NO: 2513 - DNA, 26 bp, Homo sapiens
gagaaaggagagggaaaacagtgggc

SEQ ID NO: 2514 - DNA, 26 bp, Homo sapiens
ctctgctgtgggtggtgttgaatgtc

SEQ ID NO: 2515 - DNA, 26 bp, Homo sapiens
ctctgctgtgggtggtgttgaatgtc

SEQ ID NO: 2516 - DNA, 26 bp, Homo sapiens
gggtcttgccagtaagttctgaatgg

SEQ ID NO: 2517 - DNA, 26 bp, Homo sapiens
gggtcttgccagtaagttctgaatgg

SEQ ID NO: 2518 - DNA, 26 bp, Homo sapiens
gagagtcactaagtccaatctattct

SEQ ID NO: 2519 - DNA, 26 bp, Homo sapiens
gagagtcactaagtccaatctattct

SEQ ID NO: 2520 - DNA, 23 bp, Homo sapiens
gggactccagattggttggctgc

SEQ ID NO: 2521 - DNA, 23 bp, Homo sapiens
gggactccagattggttggctgc

SEQ ID NO: 2522 - DNA, 26 bp, Homo sapiens
gctgaagacttggtcaaacctatggc

SEQ ID NO: 2523 - DNA, 26 bp, Homo sapiens
gctgaagacttggtcaaacctatggc

SEQ ID NO: 2524 - DNA, 23 bp, Homo sapiens
cacagaccaaggaccctaaccac

SEQ ID NO: 2525 - DNA, 23 bp, Homo sapiens
cacagaccaaggaccctaaccac

SEQ ID NO: 2526 - DNA, 24 bp, Homo sapiens
ctctttctgaggcttttgttcata

SEQ ID NO: 2527 - DNA, 24 bp, Homo sapiens
ctctttctgaggcttttgttcata

SEQ ID NO: 2528 - DNA, 24 bp, Homo sapiens
ttccttccccagggttattccttg

SEQ ID NO: 2529 - DNA, 24 bp, Homo sapiens
ttccttccccagggttattccttg

SEQ ID NO: 2530 - DNA, 23 bp, Homo sapiens
gctcatagaagaagcctttgggc

SEQ ID NO: 2531 - DNA, 23 bp, Homo sapiens
gctcatagaagaagcctttgggc

SEQ ID NO: 2532 - DNA, 26 bp, Homo sapiens
gctacctttccagttagggattcagc

SEQ ID NO: 2533 - DNA, 26 bp, Homo sapiens
gctacctttccagttagggattcagc

SEQ ID NO: 2534 - DNA, 26 bp, Homo sapiens
ccacttctttgctggctaacagggag

SEQ ID NO: 2535 - DNA, 26 bp, Homo sapiens
ccacttctttgctggctaacagggag

SEQ ID NO: 2536 - DNA, 26 bp, Homo sapiens
tgtgtattctgctgatgttggtggaa

SEQ ID NO: 2537 - DNA, 26 bp, Homo sapiens
tgtgtattctgctgatgttggtggaa

SEQ ID NO: 2538 - DNA, 24 bp, Homo sapiens
cagcagagtatttggagttgaaaa

SEQ ID NO: 2539 - DNA, 24 bp, Homo sapiens
cagcagagtatttggagttgaaaa

SEQ ID NO: 2540 - DNA, 23 bp, Homo sapiens
ctcacgcctgggagagtttgtgc

SEQ ID NO: 2541 - DNA, 23 bp, Homo sapiens
ctcacgcctgggagagtttgtgc

SEQ ID NO: 2542 - DNA, 23 bp, Homo sapiens
gctgagttgagccttctgcttgg

SEQ ID NO: 2543 - DNA, 23 bp, Homo sapiens
gctgagttgagccttctgcttgg

SEQ ID NO: 2544 - DNA, 25 bp, Homo sapiens
atgtgctaatctggaagactctgtc

SEQ ID NO: 2545 - DNA, 25 bp, Homo sapiens
atgtgctaatctggaagactctgtc

SEQ ID NO: 2546 - DNA, 26 bp, Homo sapiens
gcagtaaaatccataagaatgagcag

SEQ ID NO: 2547 - DNA, 26 bp, Homo sapiens
gcagtaaaatccataagaatgagcag

SEQ ID NO: 2548 - DNA, 26 bp, Homo sapiens
tgggaagtgagaagaggaggtggcaa

SEQ ID NO: 2549 - DNA, 26 bp, Homo sapiens
tgggaagtgagaagaggaggtggcaa

SEQ ID NO: 2550 - DNA, 26 bp, Homo sapiens
ctaagtgtcagtcaacccctctccta

SEQ ID NO: 2551 - DNA, 26 bp, Homo sapiens
ctaagtgtcagtcaacccctctccta

SEQ ID NO: 2552 - DNA, 26 bp, Homo sapiens
agacaggtggtgctgattcattggtg

SEQ ID NO: 2553 - DNA, 26 bp, Homo sapiens
agacaggtggtgctgattcattggtg

SEQ ID NO: 2554 - DNA, 26 bp, Homo sapiens
gtttattcaccttctccctggtctca

SEQ ID NO: 2555 - DNA, 26 bp, Homo sapiens
gtttattcaccttctccctggtctca

SEQ ID NO: 2556 - DNA, 23 bp, Homo sapiens
gggatgcttgccttgatgagtgc

SEQ ID NO: 2557 - DNA, 23 bp, Homo sapiens
gggatgcttgccttgatgagtgc

SEQ ID NO: 2558 - DNA, 23 bp, Homo sapiens
cctgcgaggcttctgagcaacag

SEQ ID NO: 2559 - DNA, 23 bp, Homo sapiens
cctgcgaggcttctgagcaacag

SEQ ID NO: 2560 - DNA, 26 bp, Homo sapiens
aaagggctcctctgacccataaacct

SEQ ID NO: 2561 - DNA, 26 bp, Homo sapiens
aaagggctcctctgacccataaacct

SEQ ID NO: 2562 - DNA, 24 bp, Homo sapiens
cagaggtaaggacaactgccaata

SEQ ID NO: 2563 - DNA, 24 bp, Homo sapiens
cagaggtaaggacaactgccaata

SEQ ID NO: 2564 - DNA, 60 bp, Homo sapiens
atcaggtcatatatctcacagagaacattcgaccatgagctctctgatacctacggttgt

SEQ ID NO: 2565 - DNA, 60 bp, Homo sapiens; identical to SEQ ID NO: 2564

SEQ ID NO: 2566 - DNA, 60 bp, Homo sapiens
aaaatagctacctatgtaatagagaacatcgaaaatgggttctgtttcaaatacatggaa

SEQ ID NO: 2567 - DNA, 60 bp, Homo sapiens; identical to SEQ ID NO: 2566

SEQ ID NO: 2568 - DNA, 60 bp, Homo sapiens; identical to SEQ ID NO: 2320

SEQ ID NO: 2569 - DNA, 60 bp, Homo sapiens; identical to SEQ ID NO: 2320

SEQ ID NO: 2570 - DNA, 60 bp, Homo sapiens
acatatacactcattctcaaaatctttctcgactgaattggaatacatatacatgcaggt

SEQ ID NO: 2571 - DNA, 60 bp, Homo sapiens; identical to SEQ ID NO: 2570

SEQ ID NO: 2572 - DNA, 60 bp, Homo sapiens
taaactatctgttaccagtccgtctctttcgaaatatgaatcatctttgtccagtatgga

SEQ ID NO: 2573 - DNA, 60 bp, Homo sapiens; identical to SEQ ID NO: 2572

SEQ ID NO: 2574 - DNA, 60 bp, Homo sapiens
gaaaaaatagttatggaagttgagaacatcgaaaataaagaccgaaagaaatgaggatat

SEQ ID NO: 2575 - DNA, 60 bp, Homo sapiens; identical to SEQ ID NO: 2574

SEQ ID NO: 2576 - DNA, 60 bp, Homo sapiens
atattttacaattttttaggtcaagaattcgatttgctatttggagagcaatgaaactga

SEQ ID NO: 2577 - DNA, 60 bp, Homo sapiens; identical to SEQ ID NO: 2576

SEQ ID NO: 2578 - DNA, 60 bp, Homo sapiens
tattacagaaaaaaaaaaatggatctcttcgaagcatgtataatttattttaggaatatg

SEQ ID NO: 2579 - DNA, 60 bp, Homo sapiens; identical to SEQ ID NO: 2578

SEQ ID NO: 2580 - DNA, 60 bp, Homo sapiens
atgtatttttcacaatatgaattaaaagtcgatgtttcaagttatgtcataggatttcaa

SEQ ID NO: 2581 - DNA, 60 bp, Homo sapiens; identical to SEQ ID NO: 2580

SEQ ID NO: 2582 - DNA, 60 bp, Homo sapiens
ttttcttttaaaggggaaaatgacaaactcgaacttcctgaatatttctgtgatttaaat

SEQ ID NO: 2583 - DNA, 60 bp, Homo sapiens; identical to SEQ ID NO: 2582

SEQ ID NO: 2584 - DNA, 60 bp, Homo sapiens
cgtaatagtttgataattttattactactcgagcaaaagcttactttttcagaaaagaaa

SEQ ID NO: 2585 - DNA, 60 bp, Homo sapiens; identical to SEQ ID NO: 2584

SEQ ID NO: 2586 - DNA, 60 bp, Homo sapiens
gcacttgtgcacttacaatctcctgtcttcgaacagaaattccttttcatattttcaaaa

SEQ ID NO: 2587 - DNA, 60 bp, Homo sapiens; identical to SEQ ID NO: 2586

SEQ ID NO: 2588 - DNA, 60 bp, Homo sapiens
ttcattctttataaacaggataaaacagtcgaaggaattcatacctagtgacagacaagc

SEQ ID NO: 2589 - DNA, 60 bp, Homo sapiens; identical to SEQ ID NO: 2588

SEQ ID NO: 2590 - DNA, 60 bp, Homo sapiens
acagaattatgaaaaaaaaaaaacaaattcgaatcctgttggagacatgatgtcatcccc

SEQ ID NO: 2591 - DNA, 60 bp, Homo sapiens; identical to SEQ ID NO: 2590

SEQ ID NO: 2592 - DNA, 60 bp, Homo sapiens
gcatttttatgaaattaaatgtccgtattcgattctcaacctcttgcttaggtacacaca

SEQ ID NO: 2593 - DNA, 60 bp, Homo sapiens; identical to SEQ ID NO: 2592

SEQ ID NO: 2594 - DNA, 60 bp, Homo sapiens
tggaattttagatggaaatttaataacttcgaaaactaaaactggatccctatctcaggc

SEQ ID NO: 2595 - DNA, 60 bp, Homo sapiens; identical to SEQ ID NO: 2594

SEQ ID NO: 2596 - DNA, 60 bp, Homo sapiens
aaaacaattaacaatgaacacgggaatatcgagtagagtataaaggatttgtgggaaata

SEQ ID NO: 2597 - DNA, 60 bp, Homo sapiens; identical to SEQ ID NO: 2596

SEQ ID NO: 2598 - DNA, 60 bp, Homo sapiens
atgaaatagtgtaatagagaaactttagtcgagtaacgctgacttcctctgagtctctcc

SEQ ID NO: 2599 - DNA, 60 bp, Homo sapiens; identical to SEQ ID NO: 2598

SEQ ID NO: 2600 - DNA, 60 bp, Homo sapiens
gagccaatacaataaatatttttttaagtcgaagatagatatagacaccctgtactgttt

SEQ ID NO: 2601 - DNA, 60 bp, Homo sapiens; identical to SEQ ID NO: 2600

SEQ ID NO: 2602 - DNA, 60 bp, Homo sapiens
gttaagaggttttaaaaatagaaacacatcgagaaatgatagagaggttactaggaaagt

SEQ ID NO: 2603 - DNA, 60 bp, Homo sapiens; identical to SEQ ID NO: 2602

SEQ ID NO: 2604 - DNA, 60 bp, Homo sapiens
taaataaataagtataaaaataaatcaatcgagagccagatatttttgtagtttttatgc

SEQ ID NO: 2605 - DNA, 60 bp, Homo sapiens; identical to SEQ ID NO: 2604

SEQ ID NO: 2606 - DNA, 60 bp, Homo sapiens
cattacatttcataattttctgaaaccctcgagaaatgttcctttatataagaaaagcga

SEQ ID NO: 2607 - DNA, 60 bp, Homo sapiens; identical to SEQ ID NO: 2606

SEQ ID NO: 2608 - DNA, 60 bp, Homo sapiens
agttttttaatctttccattttttcttttcgactgtcaccagtatcatcccttcactttc

SEQ ID NO: 2609 - DNA, 60 bp, Homo sapiens; identical to SEQ ID NO: 2608

SEQ ID NO: 2610 - DNA, 60 bp, Homo sapiens
atttcaagagagatatgctaaccctatttcgatgtaccattccttccctactctgaatgt

SEQ ID NO: 2611 - DNA, 60 bp, Homo sapiens; identical to SEQ ID NO: 2610

SEQ ID NO: 2612 - DNA, 60 bp, Homo sapiens
caagaagaagggataaaatactacttcttcgatcaaaggaaaaagaaagaaaccaaacct

SEQ ID NO: 2613 - DNA, 60 bp, Homo sapiens; identical to SEQ ID NO: 2612

SEQ ID NO: 2614 - DNA, 60 bp, Homo sapiens
tgaaggttagattttcttaataacattttcgattactgaagagtccattagagtaagcag

SEQ ID NO: 2615 - DNA, 60 bp, Homo sapiens; identical to SEQ ID NO: 2614

SEQ ID NO: 2616 - DNA, 60 bp, Homo sapiens
gtctttagttagtaacttttctggcatatcgaagttcaaatatgatgtccctctgagcct

SEQ ID NO: 2617 - DNA, 60 bp, Homo sapiens; identical to SEQ ID NO: 2616

SEQ ID NO: 2618 - DNA, 60 bp, Homo sapiens
ttttatgaaagagagtggattttttttttcgaaatggaaagtaggtttgggttcatctct

SEQ ID NO: 2619 - DNA, 60 bp, Homo sapiens; identical to SEQ ID NO: 2618

SEQ ID NO: 2620 - DNA, 60 bp, Homo sapiens
tcttttttagacaactgtttattagcagtcgagggatatttattaattatattctaaatc

SEQ ID NO: 2621 - DNA, 60 bp, Homo sapiens; identical to SEQ ID NO: 2620

SEQ ID NO: 2622 - DNA, 60 bp, Homo sapiens
acttatctttccaacttttattttggattcgagtttcctttaatcccaaagacacttggg

SEQ ID NO: 2623 - DNA, 60 bp, Homo sapiens; identical to SEQ ID NO: 2622

SEQ ID NO: 2624 - DNA, 60 bp, Homo sapiens
gaaaaatccatggtaatgaattagtttctcgaaatactttttctatactatggacaacaa

SEQ ID NO: 2625 - DNA, 60 bp, Homo sapiens; identical to SEQ ID NO: 2624

SEQ ID NO: 2626 - DNA, 60 bp, Homo sapiens
agatagcctttaaagtagctctaatatttcgaagacatacttctctgaaaatacttattg

SEQ ID NO: 2627 - DNA, 60 bp, Homo sapiens; identical to SEQ ID NO: 2626

SEQ ID NO: 2628 - DNA, 60 bp, Homo sapiens
aacctcttggcatttctcttatcaagattcgaaagaaagagaagtgaaagtctctctttg

SEQ ID NO: 2629 - DNA, 60 bp, Homo sapiens; identical to SEQ ID NO: 2628

SEQ ID NO: 2630 - DNA, 60 bp, Homo sapiens; identical to SEQ ID NO: 1113

SEQ ID NO: 2631 - DNA, 60 bp, Homo sapiens; identical to SEQ ID NO: 1113

SEQ ID NO: 2632 - DNA, 60 bp, Homo sapiens
caattaattacattttgttcaatgaaattcgattatgtcacatgtaacatgagtgattcc

SEQ ID NO: 2633 - DNA, 60 bp, Homo sapiens; identical to SEQ ID NO: 2632

SEQ ID NO: 2634 - DNA, 60 bp, Homo sapiens
taactacactaaatattgaacacaaaaatcgataagaagttacttcaacagcttcagaag

SEQ ID NO: 2635 - DNA, 60 bp, Homo sapiens; identical to SEQ ID NO: 2634

SEQ ID NO: 2636 - DNA, 60 bp, Homo sapiens
aaaaaactatcttatactcctcacttcttcgaattctatattccccatttaaaagactac

SEQ ID NO: 2637 - DNA, 60 bp, Homo sapiens; identical to SEQ ID NO: 2636

SEQ ID NO: 2638 - DNA, 60 bp, Homo sapiens
taaatagactggaagtgcttgaagcacttcgaacaaatccttttcacccattaatcaaga

SEQ ID NO: 2639 - DNA, 60 bp, Homo sapiens; identical to SEQ ID NO: 2638

SEQ ID NO: 2640 - DNA, 60 bp, Homo sapiens
tctatatattcttttcttcctcttaaaatcgatatgaacctgagatggaagttcctggag

SEQ ID NO: 2641 - DNA, 60 bp, Homo sapiens; identical to SEQ ID NO: 2640

SEQ ID NO: 2642 - DNA, 60 bp, Homo sapiens
tgtcatttttgtgacagcaaattcatcttcgactgtgaaagacgtggaagtatttttctc

SEQ ID NO: 2643 - DNA, 60 bp, Homo sapiens; identical to SEQ ID NO: 2642

SEQ ID NO: 2644 - DNA, 60 bp, Homo sapiens
ttttgaacacatttttaaaactctgagttcgatcataagacttgaaagtttagattactc

SEQ ID NO: 2645 - DNA, 60 bp, Homo sapiens; identical to SEQ ID NO: 2644

SEQ ID NO: 2646 - DNA, 60 bp, Homo sapiens
ccagttacataaagaaaggaaaaatggatcgatgagtcttttttattttgagacagggtc

SEQ ID NO: 2647 - DNA, 60 bp, Homo sapiens; identical to SEQ ID NO: 2646

SEQ ID NO: 2648 - DNA, 60 bp, Homo sapiens
gctattcaaataaacatgtattcctcattcgaccttcagaagctctggtttcatcatcca

SEQ ID NO: 2649 - DNA, 60 bp, Homo sapiens; identical to SEQ ID NO: 2648

SEQ ID NO: 2650 - DNA, 60 bp, Homo sapiens
acgttttaatatctcaagattatgagattcgaaagctcttctagatagttgttattggct

SEQ ID NO: 2651 - DNA, 60 bp, Homo sapiens; identical to SEQ ID NO: 2650

SEQ ID NO: 2652 - DNA, 60 bp, Homo sapiens
acactgagaaacactcattgaagttaactcgatagagttaaatacattttggttggatgg

SEQ ID NO: 2653 - DNA, 60 bp, Homo sapiens; identical to SEQ ID NO: 2652

SEQ ID NO: 2654 - DNA, 60 bp, Homo sapiens
gtcttgttaatctgaatgttatatgcattcgaaagctcttctagatagttgttattggct

SEQ ID NO: 2655 - DNA, 60 bp, Homo sapiens; identical to SEQ ID NO: 2654

SEQ ID NO: 2656 - DNA, 60 bp, Homo sapiens
aggagttaattagccaaagggaaaacaatcgaagattgttgctgagaaaagtcaatatga

SEQ ID NO: 2657 - DNA, 60 bp, Homo sapiens; identical to SEQ ID NO: 2656

SEQ ID NO: 2658 - DNA, 60 bp, Homo sapiens
aaacttataacttctgccaattctcccttcgaatatttgcaaggcaggattttgtaatta

SEQ ID NO: 2659 - DNA, 60 bp, Homo sapiens; identical to SEQ ID NO: 2658

SEQ ID NO: 2660 - DNA, 60 bp, Homo sapiens
acaatatatacttgaagaatattgtccttcgagtatgtctttatcaacggcatgagaaca

SEQ ID NO: 2661 - DNA, 60 bp, Homo sapiens; identical to SEQ ID NO: 2660

SEQ ID NO: 2662 - DNA, 60 bp, Homo sapiens
aatcaagctaattaacacattcataacctcgaatttctttccaacgaaggaacttgtgaa

SEQ ID NO: 2663 - DNA, 60 bp, Homo sapiens; identical to SEQ ID NO: 2662

SEQ ID NO: 2664 - DNA, 60 bp, Homo sapiens
tgagtgaatataaatcactaaaacatgttcgaacaggaaacgtcatagagaaaactcagc

SEQ ID NO: 2665 - DNA, 60 bp, Homo sapiens; identical to SEQ ID NO: 2664

SEQ ID NO: 2666 - DNA, 60 bp, Homo sapiens
ccttgtacttactgctagtcttctgttatcgacaattactatcaaatgtctataaccatt

SEQ ID NO: 2667 - DNA, 60 bp, Homo sapiens; identical to SEQ ID NO: 2666

SEQ ID NO: 2668 - DNA, 60 bp, Homo sapiens
ttttattgctttttaaaagagcttgtcatcgaagctccttgtggacaagtagataatgtg

SEQ ID NO: 2669 - DNA, 60 bp, Homo sapiens; identical to SEQ ID NO: 2668

SEQ ID NO: 2670 - DNA, 26 bp, Homo sapiens
ggcgatttagacaggttagacatcca

SEQ ID NO: 2671 - DNA, 26 bp, Homo sapiens
ggcgatttagacaggttagacatcca

SEQ ID NO: 2672 - DNA, 24 bp, Homo sapiens
ttatgaatgctaacaaagtgctgt

SEQ ID NO: 2673 - DNA, 24 bp, Homo sapiens
ttatgaatgctaacaaagtgctgt

SEQ ID NO: 2674 - DNA, 23 bp, Homo sapiens
ggtctgaacacagtcttggctgg

SEQ ID NO: 2675 - DNA, 23 bp, Homo sapiens
ggtctgaacacagtcttggctgg

SEQ ID NO: 2676 - DNA, 24 bp, Homo sapiens
cttttagaagagaaataggagatt

SEQ ID NO: 2677 - DNA, 24 bp, Homo sapiens
cttttagaagagaaataggagatt

SEQ ID NO: 2678 - DNA, 26 bp, Homo sapiens
tctctttccagacactgctcggcact

SEQ ID NO: 2679 - DNA, 26 bp, Homo sapiens
tctctttccagacactgctcggcact

SEQ ID NO: 2680 - DNA, 26 bp, Homo sapiens
gaatgagtaatgagatgggagatggg

SEQ ID NO: 2681 - DNA, 26 bp, Homo sapiens
gaatgagtaatgagatgggagatggg

SEQ ID NO: 2682 - DNA, 26 bp, Homo sapiens
caaactactctaatcccaggtggcta

SEQ ID NO: 2683 - DNA, 26 bp, Homo sapiens
caaactactctaatcccaggtggcta

SEQ ID NO: 2684 - DNA, 26 bp, Homo sapiens
aatctgaacttagacaggctggctgc

SEQ ID NO: 2685 - DNA, 26 bp, Homo sapiens
aatctgaacttagacaggctggctgc

SEQ ID NO: 2686 - DNA, 26 bp, Homo sapiens
ctcatctcctgccaaaacgcaatggg

SEQ ID NO: 2687 - DNA, 26 bp, Homo sapiens
ctcatctcctgccaaaacgcaatggg

SEQ ID NO: 2688 - DNA, 26 bp, Homo sapiens
cctccaggtagagagtgtcagaagtg

SEQ ID NO: 2689 - DNA, 26 bp, Homo sapiens
cctccaggtagagagtgtcagaagtg

SEQ ID NO: 2690 - DNA, 26 bp, Homo sapiens
tcctctgttctcaactcggtctcagt

SEQ ID NO: 2691 - DNA, 26 bp, Homo sapiens
tcctctgttctcaactcggtctcagt

SEQ ID NO: 2692 - DNA, 23 bp, Homo sapiens
tccgctcctctcctcttctctta

SEQ ID NO: 2693 - DNA, 23 bp, Homo sapiens
tccgctcctctcctcttctctta

SEQ ID NO: 2694 - DNA, 26 bp, Homo sapiens
gcctttccattgaagcccattcttac

SEQ ID NO: 2695 - DNA, 26 bp, Homo sapiens
gcctttccattgaagcccattcttac

SEQ ID NO: 2696 - DNA, 26 bp, Homo sapiens
aggaggctgtgtagaccaaaaccacg

SEQ ID NO: 2697 - DNA, 26 bp, Homo sapiens
aggaggctgtgtagaccaaaaccacg

SEQ ID NO: 2698 - DNA, 26 bp, Homo sapiens
gcctttcctttctggcatcatctgtt

SEQ ID NO: 2699 - DNA, 26 bp, Homo sapiens
gcctttcctttctggcatcatctgtt

SEQ ID NO: 2700 - DNA, 26 bp, Homo sapiens
tatgttacaccccttggctacccagc

SEQ ID NO: 2701 - DNA, 26 bp, Homo sapiens
tatgttacaccccttggctacccagc

SEQ ID NO: 2702 - DNA, 24 bp, Homo sapiens
cttggagtttcttcaaataaaatc

SEQ ID NO: 2703 - DNA, 24 bp, Homo sapiens
cttggagtttcttcaaataaaatc

SEQ ID NO: 2704 - DNA, 24 bp, Homo sapiens
tggagagaaagacatcaatcacat

SEQ ID NO: 2705 - DNA, 24 bp, Homo sapiens
tggagagaaagacatcaatcacat

SEQ ID NO: 2706 - DNA, 26 bp, Homo sapiens
ggttgaggaggcgtatcatttagcac

SEQ ID NO: 2707 - DNA, 26 bp, Homo sapiens
ggttgaggaggcgtatcatttagcac

SEQ ID NO: 2708 - DNA, 26 bp, Homo sapiens
ctctgaagccaagcatagatagatgg

SEQ ID NO: 2709 - DNA, 26 bp, Homo sapiens
ctctgaagccaagcatagatagatgg

SEQ ID NO: 2710 - DNA, 23 bp, Homo sapiens
gctgggtgcgatgtgtgcctcta

SEQ ID NO: 2711 - DNA, 23 bp, Homo sapiens
gctgggtgcgatgtgtgcctcta

SEQ ID NO: 2712 - DNA, 26 bp, Homo sapiens
ccctaactttgacttgctatgtgata

SEQ ID NO: 2713 - DNA, 26 bp, Homo sapiens
ccctaactttgacttgctatgtgata

SEQ ID NO: 2714 - DNA, 23 bp, Homo sapiens
cccttccttctcctgtaagtagc

SEQ ID NO: 2715 - DNA, 23 bp, Homo sapiens
cccttccttctcctgtaagtagc

SEQ ID NO: 2716 - DNA, 26 bp, Homo sapiens
gggacattagtttacccagtatggac

SEQ ID NO: 2717 - DNA, 26 bp, Homo sapiens
gggacattagtttacccagtatggac

SEQ ID NO: 2718 - DNA, 26 bp, Homo sapiens
ggagagagactgaaggcaggaatgct

SEQ ID NO: 2719 - DNA, 26 bp, Homo sapiens
ggagagagactgaaggcaggaatgct

SEQ ID NO: 2720 - DNA, 26 bp, Homo sapiens
gaagtttcaaataggcaagccaaccc

SEQ ID NO: 2721 - DNA, 26 bp, Homo sapiens
gaagtttcaaataggcaagccaaccc

SEQ ID NO: 2722 - DNA, 24 bp, Homo sapiens
gcttaggcagggcaatgtgcttcc

SEQ ID NO: 2723 - DNA, 24 bp, Homo sapiens
gcttaggcagggcaatgtgcttcc

SEQ ID NO: 2724 - DNA, 26 bp, Homo sapiens
agatggctgtggtgttcgctttggca

SEQ ID NO: 2725 - DNA, 26 bp, Homo sapiens
agatggctgtggtgttcgctttggca

SEQ ID NO: 2726 - DNA, 26 bp, Homo sapiens
cacagccaatctgactggagagtagg

SEQ ID NO: 2727 - DNA, 26 bp, Homo sapiens
cacagccaatctgactggagagtagg

SEQ ID NO: 2728 - DNA, 26 bp, Homo sapiens
gtcctggtccctaaggcttcacttga

SEQ ID NO: 2729 - DNA, 26 bp, Homo sapiens
gtcctggtccctaaggcttcacttga

SEQ ID NO: 2730 - DNA, 26 bp, Homo sapiens
gggtctcccaatctcccttgatactt

SEQ ID NO: 2731 - DNA, 26 bp, Homo sapiens
gggtctcccaatctcccttgatactt

SEQ ID NO: 2732 - DNA, 26 bp, Homo sapiens
attggtggtttccctctccttgtgat

SEQ ID NO: 2733 - DNA, 26 bp, Homo sapiens
attggtggtttccctctccttgtgat

SEQ ID NO: 2734 - DNA, 23 bp, Homo sapiens
cgccagggagggcataatctctg

SEQ ID NO: 2735 - DNA, 23 bp, Homo sapiens
cgccagggagggcataatctctg

SEQ ID NO: 2736 - DNA, 26 bp, Homo sapiens
ccaccagcagttattgagcattcctt

SEQ ID NO: 2737 - DNA, 26 bp, Homo sapiens
ccaccagcagttattgagcattcctt

SEQ ID NO: 2738 - DNA, 23 bp, Homo sapiens
gccatccaggcagccagatactc

SEQ ID NO: 2739 - DNA, 23 bp, Homo sapiens
gccatccaggcagccagatactc

SEQ ID NO: 2740 - DNA, 23 bp, Homo sapiens
ccccttaggaatgagatgggagg

SEQ ID NO: 2741 - DNA, 23 bp, Homo sapiens
ccccttaggaatgagatgggagg

SEQ ID NO: 2742 - DNA, 24 bp, Homo sapiens
agcagccaagttttagatttcata

SEQ ID NO: 2743 - DNA, 24 bp, Homo sapiens
agcagccaagttttagatttcata

SEQ ID NO: 2744 - DNA, 26 bp, Homo sapiens
gaaatcttccaataatctactgcggc

SEQ ID NO: 2745 - DNA, 26 bp, Homo sapiens
gaaatcttccaataatctactgcggc

SEQ ID NO: 2746 - DNA, 26 bp, Homo sapiens
cttctgagccttatgaaaacgggcat

SEQ ID NO: 2747 - DNA, 26 bp, Homo sapiens
cttctgagccttatgaaaacgggcat

SEQ ID NO: 2748 - DNA, 26 bp, Homo sapiens
cccaactctctcctttgacacaacag

SEQ ID NO: 2749 - DNA, 26 bp, Homo sapiens
cccaactctctcctttgacacaacag

SEQ ID NO: 2750 - DNA, 23 bp, Homo sapiens
tcctcccacttcacctcctgtgc

SEQ ID NO: 2751 - DNA, 23 bp, Homo sapiens
tcctcccacttcacctcctgtgc

SEQ ID NO: 2752 - DNA, 23 bp, Homo sapiens
caacaaccttttcctcacacgca

SEQ ID NO: 2753 - DNA, 23 bp, Homo sapiens
caacaaccttttcctcacacgca

SEQ ID NO: 2754 - DNA, 23 bp, Homo sapiens
gccctcttcctttccctcctgta

SEQ ID NO: 2755 - DNA, 23 bp, Homo sapiens
gccctcttcctttccctcctgta

SEQ ID NO: 2756 - DNA, 26 bp, Homo sapiens
tccctttgctaaacttgcctctgccc

SEQ ID NO: 2757 - DNA, 26 bp, Homo sapiens
tccctttgctaaacttgcctctgccc

SEQ ID NO: 2758 - DNA, 26 bp, Homo sapiens
atccagaatgaggctctccccagcat

SEQ ID NO: 2759 - DNA, 26 bp, Homo sapiens
atccagaatgaggctctccccagcat

SEQ ID NO: 2760 - DNA, 26 bp, Homo sapiens
gacaaatcttctgttccacaagttag

SEQ ID NO: 2761 - DNA, 26 bp, Homo sapiens
gacaaatcttctgttccacaagttag

SEQ ID NO: 2762 - DNA, 26 bp, Homo sapiens
ctacttggagaacaaaagccaccagc

SEQ ID NO: 2763 - DNA, 26 bp, Homo sapiens
ctacttggagaacaaaagccaccagc

SEQ ID NO: 2764 - DNA, 26 bp, Homo sapiens
gctggctttactgataacttccgagg

SEQ ID NO: 2765 - DNA, 26 bp, Homo sapiens
gctggctttactgataacttccgagg

SEQ ID NO: 2766 - DNA, 23 bp, Homo sapiens
gcgacacctgctggttgagagtg

SEQ ID NO: 2767 - DNA, 23 bp, Homo sapiens
gcgacacctgctggttgagagtg

SEQ ID NO: 2768 - DNA, 24 bp, Homo sapiens
tggttattttggagaggaaagaaa

SEQ ID NO: 2769 - DNA, 24 bp, Homo sapiens
tggttattttggagaggaaagaaa

SEQ ID NO: 2770 - DNA, 26 bp, Homo sapiens
gatgactgttttcagagacaatggaa

SEQ ID NO: 2771 - DNA, 26 bp, Homo sapiens
gatgactgttttcagagacaatggaa

SEQ ID NO: 2772 - DNA, 26 bp, Homo sapiens
gcaatgaagtctctaactgatgaggc

SEQ ID NO: 2773 - DNA, 26 bp, Homo sapiens
gcaatgaagtctctaactgatgaggc

SEQ ID NO: 2774 - DNA, 24 bp, Homo sapiens
ttcagaaatcaaagcccaaaatgc

SEQ ID NO: 2775 - DNA, 24 bp, Homo sapiens
ttcagaaatcaaagcccaaaatgc

SEQ ID NO: 2776 - DNA, 26 bp, Homo sapiens
cttccctctttcactctctccacctc

SEQ ID NO: 2777 - DNA, 26 bp, Homo sapiens
cttccctctttcactctctccacctc

SEQ ID NO: 2778 - DNA, 24 bp, Homo sapiens
tctccagttgttagtgtttcaata

SEQ ID NO: 2779 - DNA, 24 bp, Homo sapiens
tctccagttgttagtgtttcaata

SEQ ID NO: 2780 - DNA, 23 bp, Homo sapiens
ctcacgcctgggagagtttgtgc

SEQ ID NO: 2781 - DNA, 23 bp, Homo sapiens
ctcacgcctgggagagtttgtgc

SEQ ID NO: 2782 - DNA, 24 bp, Homo sapiens
actacggagattccaaactggcag

SEQ ID NO: 2783 - DNA, 24 bp, Homo sapiens
actacggagattccaaactggcag

SEQ ID NO: 2784 - DNA, 24 bp, Homo sapiens
tacccgacttgccagtatcactac

SEQ ID NO: 2785 - DNA, 24 bp, Homo sapiens
tacccgacttgccagtatcactac

SEQ ID NO: 2786 - DNA, 26 bp, Homo sapiens
ccctgttcctcccacttcctcttaga

SEQ ID NO: 2787 - DNA, 26 bp, Homo sapiens
ccctgttcctcccacttcctcttaga

SEQ ID NO: 2788 - DNA, 26 bp, Homo sapiens
gacacctaccaacccagatgctcttg

SEQ ID NO: 2789 - DNA, 26 bp, Homo sapiens
gacacctaccaacccagatgctcttg

SEQ ID NO: 2790 - DNA, 26 bp, Homo sapiens
ggagcctaaagttatgggaatgtcat

SEQ ID NO: 2791 - DNA, 26 bp, Homo sapiens
ggagcctaaagttatgggaatgtcat

SEQ ID NO: 2792 - DNA, 26 bp, Homo sapiens
caccgtttcacctgtgctatctttga

SEQ ID NO: 2793 - DNA, 26 bp, Homo sapiens
caccgtttcacctgtgctatctttga

SEQ ID NO: 2794 - DNA, 26 bp, Homo sapiens
ggctttactttgtgactggcttggta

SEQ ID NO: 2795 - DNA, 26 bp, Homo sapiens
ggctttactttgtgactggcttggta

SEQ ID NO: 2796 - DNA, 26 bp, Homo sapiens
tgggcaagtttgactggacattttct

SEQ ID NO: 2797 - DNA, 26 bp, Homo sapiens
tgggcaagtttgactggacattttct

SEQ ID NO: 2798 - DNA, 25 bp, Homo sapiens
gctgttagcatcagaaatgaatggc

SEQ ID NO: 2799 - DNA, 25 bp, Homo sapiens
gctgttagcatcagaaatgaatggc

SEQ ID NO: 2800 - DNA, 26 bp, Homo sapiens
ccagtgcctactcccaaacgacgatt

SEQ ID NO: 2801 - DNA, 26 bp, Homo sapiens
ccagtgcctactcccaaacgacgatt

SEQ ID NO: 2802 - DNA, 26 bp, Homo sapiens
agtgtgaatacccaggaaacttagcg

SEQ ID NO: 2803 - DNA, 26 bp, Homo sapiens
agtgtgaatacccaggaaacttagcg

SEQ ID NO: 2804 - DNA, 26 bp, Homo sapiens
ggaaagattgtgggtaggtgctgggt

SEQ ID NO: 2805 - DNA, 26 bp, Homo sapiens
ggaaagattgtgggtaggtgctgggt

SEQ ID NO: 2806 - DNA, 26 bp, Homo sapiens
cttagtcataaatcctttggcagacc

SEQ ID NO: 2807 - DNA, 26 bp, Homo sapiens
cttagtcataaatcctttggcagacc

SEQ ID NO: 2808 - DNA, 25 bp, Homo sapiens
cttgaactacttatcctattcttta

SEQ ID NO: 2809 - DNA, 25 bp, Homo sapiens
cttgaactacttatcctattcttta

SEQ ID NO: 2810 - DNA, 24 bp, Homo sapiens
agtgggaataaacttgtatggtat

SEQ ID NO: 2811 - DNA, 24 bp, Homo sapiens
agtgggaataaacttgtatggtat

SEQ ID NO: 2812 - DNA, 26 bp, Homo sapiens
tcctgtgatgggaatcctttctctgc

SEQ ID NO: 2813 - DNA, 26 bp, Homo sapiens
tcctgtgatgggaatcctttctctgc

SEQ ID NO: 2814 - DNA, 26 bp, Homo sapiens
gtaagaacttcctggtgcccatcctc

SEQ ID NO: 2815 - DNA, 26 bp, Homo sapiens
gtaagaacttcctggtgcccatcctc

SEQ ID NO: 2816 - DNA, 23 bp, Homo sapiens
agtgttcctgacagtgtaggcgg

SEQ ID NO: 2817 - DNA, 23 bp, Homo sapiens
agtgttcctgacagtgtaggcgg

SEQ ID NO: 2818 - DNA, 26 bp, Homo sapiens
ctggagaggaggagtcttgtttgctt

SEQ ID NO: 2819 - DNA, 26 bp, Homo sapiens
ctggagaggaggagtcttgtttgctt

SEQ ID NO: 2820 - DNA, 23 bp, Homo sapiens
tagtgagccaagattgtgccctt

SEQ ID NO: 2821 - DNA, 23 bp, Homo sapiens
tagtgagccaagattgtgccctt

SEQ ID NO: 2822 - DNA, 25 bp, Homo sapiens
ctgacacagtcctaagcacagacat

SEQ ID NO: 2823 - DNA, 25 bp, Homo sapiens
ctgacacagtcctaagcacagacat

SEQ ID NO: 2824 - DNA, 26 bp, Homo sapiens
ggtgagagtgacttggtgactttgaa

SEQ ID NO: 2825 - DNA, 26 bp, Homo sapiens
ggtgagagtgacttggtgactttgaa

SEQ ID NO: 2826 - DNA, 26 bp, Homo sapiens
gacaccacttatgtaactcctgttta

SEQ ID NO: 2827 - DNA, 26 bp, Homo sapiens
gacaccacttatgtaactcctgttta

SEQ ID NO: 2828 - DNA, 23 bp, Homo sapiens
gaccccagggaaagagggagtat

SEQ ID NO: 2829 - DNA, 23 bp, Homo sapiens
gaccccagggaaagagggagtat

SEQ ID NO: 2830 - DNA, 26 bp, Homo sapiens
agggagcaaagattatcagacagtgc

SEQ ID NO: 2831 - DNA, 26 bp, Homo sapiens
agggagcaaagattatcagacagtgc

SEQ ID NO: 2832 - DNA, 26 bp, Homo sapiens
cttcctacattcgcttgactggtgat

SEQ ID NO: 2833 - DNA, 26 bp, Homo sapiens
cttcctacattcgcttgactggtgat

SEQ ID NO: 2834 - DNA, 26 bp, Homo sapiens
ggaccacatacttacatttggaccac

SEQ ID NO: 2835 - DNA, 26 bp, Homo sapiens
ggaccacatacttacatttggaccac

SEQ ID NO: 2836 - DNA, 26 bp, Homo sapiens
caatgaaggaaaagagagggaggagg

SEQ ID NO: 2837 - DNA, 26 bp, Homo sapiens
caatgaaggaaaagagagggaggagg

SEQ ID NO: 2838 - DNA, 26 bp, Homo sapiens
gaatggaagcaacttgagggcagacc

SEQ ID NO: 2839 - DNA, 26 bp, Homo sapiens
gaatggaagcaacttgagggcagacc

SEQ ID NO: 2840 - DNA, 23 bp, Homo sapiens
caaagccaggatgggactcagag

SEQ ID NO: 2841 - DNA, 23 bp, Homo sapiens
caaagccaggatgggactcagag

SEQ ID NO: 2842 - DNA, 26 bp, Homo sapiens
aggctgtgcttggctggttgtgtaac

SEQ ID NO: 2843 - DNA, 26 bp, Homo sapiens
aggctgtgcttggctggttgtgtaac

SEQ ID NO: 2844 - DNA, 23 bp, Homo sapiens
cccctaacagaccagaccaaacc

SEQ ID NO: 2845 - DNA, 23 bp, Homo sapiens
cccctaacagaccagaccaaacc

SEQ ID NO: 2846 - DNA, 23 bp, Homo sapiens
cgcctgtcagtgggagtgggaaa

SEQ ID NO: 2847 - DNA, 23 bp, Homo sapiens
cgcctgtcagtgggagtgggaaa

SEQ ID NO: 2848 - DNA, 24 bp, Homo sapiens
ccaaagttctgggattacaggcat

SEQ ID NO: 2849 - DNA, 24 bp, Homo sapiens
ccaaagttctgggattacaggcat

SEQ ID NO: 2850 - DNA, 23 bp, Homo sapiens
cagtctctttctctctggaatcc

SEQ ID NO: 2851 - DNA, 23 bp, Homo sapiens
cagtctctttctctctggaatcc

SEQ ID NO: 2852 - DNA, 26 bp, Homo sapiens
gtcctgaactcatcccgtcttctcca

SEQ ID NO: 2853 - DNA, 26 bp, Homo sapiens
gtcctgaactcatcccgtcttctcca

SEQ ID NO: 2854 - DNA, 26 bp, Homo sapiens
ttgtccacatcttccccatctgagaa

SEQ ID NO: 2855 - DNA, 26 bp, Homo sapiens
ttgtccacatcttccccatctgagaa

SEQ ID NO: 2856 - DNA, 26 bp, Homo sapiens
tacattcctggtaacacagcatccat

SEQ ID NO: 2857 - DNA, 26 bp, Homo sapiens
tacattcctggtaacacagcatccat

SEQ ID NO: 2858 - DNA, 23 bp, Homo sapiens
agcctgggtgacagagtgagacc

SEQ ID NO: 2859 - DNA, 23 bp, Homo sapiens
agcctgggtgacagagtgagacc

SEQ ID NO: 2860 - DNA, 23 bp, Homo sapiens
atggaggtggtgggcaatggcac

SEQ ID NO: 2861 - DNA, 23 bp, Homo sapiens
atggaggtggtgggcaatggcac

SEQ ID NO: 2862 - DNA, 24 bp, Homo sapiens
gggagaggataggtttagttgcct

SEQ ID NO: 2863 - DNA, 24 bp, Homo sapiens
gggagaggataggtttagttgcct

SEQ ID NO: 2864 - DNA, 26 bp, Homo sapiens
gagaagacaggaacactgatgctatc

SEQ ID NO: 2865 - DNA, 26 bp, Homo sapiens
gagaagacaggaacactgatgctatc

SEQ ID NO: 2866 - DNA, 24 bp, Homo sapiens
gggagaggataggtttagttgcct

SEQ ID NO: 2867 - DNA, 24 bp, Homo sapiens
gggagaggataggtttagttgcct

SEQ ID NO: 2868 - DNA, 26 bp, Homo sapiens
tgtgccctggagaaacagtctatctg

SEQ ID NO: 2869 - DNA, 26 bp, Homo sapiens
tgtgccctggagaaacagtctatctg

SEQ ID NO: 2870 - DNA, 26 bp, Homo sapiens
ctccttcctcagcctttctgtttgac

SEQ ID NO: 2871 - DNA, 26 bp, Homo sapiens
ctccttcctcagcctttctgtttgac

SEQ ID NO: 2872 - DNA, 23 bp, Homo sapiens
cccacatcagggcagaaccattc

SEQ ID NO: 2873 - DNA, 23 bp, Homo sapiens
cccacatcagggcagaaccattc

SEQ ID NO: 2874 - DNA, 24 bp, Homo sapiens
aggaaagcctcagtgttagaatgc

SEQ ID NO: 2875 - DNA, 24 bp, Homo sapiens
aggaaagcctcagtgttagaatgc

SEQ ID NO: 2876 - DNA, 26 bp, Homo sapiens
taagcaaagcccttcttcccctgtct

SEQ ID NO: 2877 - DNA, 26 bp, Homo sapiens
taagcaaagcccttcttcccctgtct

SEQ ID NO: 2878 - DNA, 26 bp, Homo sapiens
gctggtggaaggattgtaaacaggga

SEQ ID NO: 2879 - DNA, 26 bp, Homo sapiens
gctggtggaaggattgtaaacaggga

SEQ ID NO: 2880 - DNA, 24 bp, Homo sapiens
ctaactcgctaacatttcactttt

SEQ ID NO: 2881 - DNA, 24 bp, Homo sapiens
ctaactcgctaacatttcactttt

SEQ ID NO: 2882 - DNA, 60 bp, Homo sapiens
tctcttctaaagaatgttaaataaatattcgaacattccaaaatgcagagatactcatgg

SEQ ID NO: 2883 - DNA, 60 bp, Homo sapiens
tgtctaaaaagtaaaaaagaatattggctcgatgatacttaaatttttggtcagaacagg

SEQ ID NO: 2884 - DNA, 60 bp, Homo sapiens
agcaggaggatcatctgagctcagtagttcgaacctcatgtttagggcccagcaagtccc

SEQ ID NO: 2885 - DNA, 60 bp, Homo sapiens
caataaaaatgaatgcttagtaaatccatcgaggccgcagtgagctatgactgagccacc

SEQ ID NO: 2886 - DNA, 60 bp, Homo sapiens
gaggctgagatatgaggatctcttgaactcgaattccagtgtctataaataaagttttat

SEQ ID NO: 2887 - DNA, 60 bp, Homo sapiens
ttgtcctcattattattctttctaatactcgagatataatttacatatcatacaattcat

SEQ ID NO: 2888 - DNA, 60 bp, Homo sapiens
ggccggcagatcacttcaggtcaagagttcgacttccttaaagtttcattttgatgaagt

SEQ ID NO: 2889 - DNA, 60 bp, Homo sapiens
ggccggcagatcacttcaggtcaagagttcgatgatgatataggcattaaaacatgagtt

SEQ ID NO: 2890 - DNA, 60 bp, Homo sapiens
tttttattttatcttttattttattttttcgaagtattactattctcactttatagatga

SEQ ID NO: 2891 - DNA, 60 bp, Homo sapiens
ggcaggtgaatcagctgagttcaggagttcgatgtgggtcttggaacatatcccctccag

SEQ ID NO: 2892 - DNA, 60 bp, Homo sapiens
ggcaggtgaatcagctgagttcaggagttcgattccacataatctcttccaaaaagaaga

SEQ ID NO: 2893 - DNA, 60 bp, Homo sapiens
ggcaggtgaatcagctgagttcaggagttcgattagcccagtatctcattgctgtatctt

SEQ ID NO: 2894 - DNA, 60 bp, Homo sapiens
caaagctgaaagcttacacttcattgaatcgaaaatgcatttcttatgttactgtcttgt

SEQ ID NO: 2895 - DNA, 60 bp, Homo sapiens
gtatcacccctggccattacattatccatcgataaggattctatagagtcagattctcta

SEQ ID NO: 2896 - DNA, 60 bp, Homo sapiens
gtatcacccctggccattacattatccatcgacctcccaaagagacaattgttttttaaa

SEQ ID NO: 2897 - DNA, 60 bp, Homo sapiens; identical to SEQ ID NO: 1632

SEQ ID NO: 2898 - DNA, 60 bp, Homo sapiens
attacatttcatatatttcagtccattttcgaaataatacaaccgtttgtctcttatcta

SEQ ID NO: 2899 - DNA, 60 bp, Homo sapiens
cttaaagataaacaatatgtgtattaactcgatgatatctgcattaatttttaaatttga

SEQ ID NO: 2900 - DNA, 60 bp, Homo sapiens
ttcaacagtcatacatattttaaagaattcgaaataagttttattttgatactgatataa

SEQ ID NO: 2901 - DNA, 60 bp, Homo sapiens
agcagatggatcacatgaggtcaggagttcgaacttctgacctcaggtgatacacctgcc

SEQ ID NO: 2902 - DNA, 60 bp, Homo sapiens
tttaaaattgttgacagaaaatatattatcgataacatcttgacagagttaaagtttcaa

SEQ ID NO: 2903 - DNA, 60 bp, Homo sapiens
ctattctaaggatatacttgaactataatcgaattatgtctgcttaaaagtctggtacaa

SEQ ID NO: 2904 - DNA, 60 bp, Homo sapiens; identical to SEQ ID NO: 878

SEQ ID NO: 2905 - DNA, 60 bp, Homo sapiens
ttaaatgtaccaatcttttattttatagtcgagaaaagtctgaactaaatctgttaaggt

SEQ ID NO: 2906 - DNA, 60 bp, Homo sapiens
tcagagttggaagtacccttaaaggccatcgagcgttttatgtggactctccttttttct

SEQ ID NO: 2907 - DNA, 60 bp, Homo sapiens
acaggtattagggtgtttattttgcttctcgattcaaaagggcagataattttggagcaa

SEQ ID NO: 2908 - DNA, 60 bp, Homo sapiens; identical to SEQ ID NO: 2885

SEQ ID NO: 2909 - DNA, 60 bp, Homo sapiens
gaggcgggtgattcacaaggtcagatgttcgaaaattaattttatgtctgtggcttctaa

SEQ ID NO: 2910 - DNA, 60 bp, Homo sapiens
tttttagtttgattatagtttataataatcgactctttcccagtaatctactaggtaatt

SEQ ID NO: 2911 - DNA, 60 bp, Homo sapiens
agtatatctacaatacacatactgtgaatcgaatgtttccctgggatttttggactttca

SEQ ID NO: 2912 - DNA, 60 bp, Homo sapiens
agcaggtggatcacctgcggtcaggagttcgatgggaaactaatcaataagaaattagat

SEQ ID NO: 2913 - DNA, 60 bp, Homo sapiens
gagtaattcaccaaagtcacaaattcactcgacactccagagattgtgaatgtcctttta

SEQ ID NO: 2914 - DNA, 60 bp, Homo sapiens
tgtaaagttttcatatataaaatcaaattcgacaacagggtaagggttagaacccaagtt

SEQ ID NO: 2915 - DNA, 60 bp, Homo sapiens
tctcaaaaaaaaaaaaaaaattggtgtctcgaggatgggagcgtttccatggcaacttga

SEQ ID NO: 2916 - DNA, 60 bp, Homo sapiens
atgggatggatcacttgagataaggagttcgatgcttggagctgtagaagtaaacagaga

SEQ ID NO: 2917 - DNA, 60 bp, Homo sapiens
ggcaggtggacaacctgaggtcaggagttcgatctcctgacctcatgattcccctgcctc

SEQ ID NO: 2918 - DNA, 60 bp, Homo sapiens
taaaattttttttaagaagaaaaaagactcgaaacctcttccagaaaaaaatactaacgg

SEQ ID NO: 2919 - DNA, 60 bp, Homo sapiens
agcagatggatcacatgaggtcaggagttcgatctcctgacctcaagtgttccgcccacc

SEQ ID NO: 2920 - DNA, 60 bp, Homo sapiens
gccaggcagatcatgtgagatcaggagttcgaaccctccctttgatctattccattctca

SEQ ID NO: 2921 - DNA, 60 bp, Homo sapiens
aatgttacttattatgattattagataatcgataaatctaacaatttagataaaaatggg

SEQ ID NO: 2922 - DNA, 60 bp, Homo sapiens
ttatctttataaatcataccatatagcttcgaggaactgatctttaatttttctttaatt

SEQ ID NO: 2923 - DNA, 60 bp, Homo sapiens
agagcaataataatatctatgaccaatatcgaactcagggaaattaatgtttgaagagtt

SEQ ID NO: 2924 - DNA, 60 bp, Homo sapiens
tgaaaataaaagattatttaatcaagaatcgattaggatggagaatagtaacacaaaatt

SEQ ID NO: 2925 - DNA, 60 bp, Homo sapiens; identical to SEQ ID NO: 200

SEQ ID NO: 2926 - DNA, 60 bp, Homo sapiens
ctgcaggtgtgtgcattaaggagcaacttcgaaccaacgtttcttacagtggtcggggga

SEQ ID NO: 2927 - DNA, 60 bp, Homo sapiens
ctgcaggtgtgtgcattaaggagcaacttcgagatggtttatgaaactttaaggaatttt

SEQ ID NO: 2928 - DNA, 60 bp, Homo sapiens
gctatttttagtgagtgcctgggtatattcgacaaaaacatacaggcacctgtgagcttt

SEQ ID NO: 2929 - DNA, 60 bp, Homo sapiens
atgccattcttttgttttcttttgtttttcgactagtcctgattttgtacacatgaaaat

SEQ ID NO: 2930 - DNA, 60 bp, Homo sapiens
ttttatgtatgatatttgcgtgagattctcgatttccacttagtacacacagtgaaaggg

SEQ ID NO: 2931 - DNA, 60 bp, Homo sapiens
aggtgggtggatccacgatgtcaggagatcgattgagcttaacagcataattattattag

SEQ ID NO: 2932 - DNA, 60 bp, Homo sapiens
cttccagtacctgagtcagtctgagaaatcgaactcctgacctcaggcagtcaccttctt

SEQ ID NO: 2933 - DNA, 60 bp, Homo sapiens
tgtcttgaggcttactagtgcactcccgtcgaattatgtttaaagatgtaaattattatt

SEQ ID NO: 2934 - DNA, 60 bp, Homo sapiens
gctgagagtcaggtggacaggactctcctcgaaactctgcctgtttttgccttttacttt

SEQ ID NO: 2935 - DNA, 60 bp, Homo sapiens
tatttgtaaatattttagtatttacaaatcgattatgatagtagattgtagaaaaaaaca

SEQ ID NO: 2936 - DNA, 60 bp, Homo sapiens
ccttataatttagttaatgaaaatataatcgaataaagtattcagaagtaagcctggaaa

SEQ ID NO: 2937 - DNA, 60 bp, Homo sapiens
ttccactctggaaaacatatcacttctctcgatacctatattaagaaagaagaaaggtct

SEQ ID NO: 2938 - DNA, 60 bp, Homo sapiens
ttatccataaccataagatattctaagatcgaatagtgacacttatgcagaggagagaat

SEQ ID NO: 2939 - DNA, 60 bp, Homo sapiens
tttaggaagtttttttattatcattttttcgaaacacccgattgtttaaattttaatgac

SEQ ID NO: 2940 - DNA, 60 bp, Homo sapiens
cctgtaagattccatttatacaacattatcgagcaattccactatgggtatatatccaaa

SEQ ID NO: 2941 - DNA, 60 bp, Homo sapiens; identical to SEQ ID NO: 1574

SEQ ID NO: 2942 - DNA, 60 bp, Homo sapiens
gtagatatccaaacatttatgaaattaatcgagaacaaaagggcataatgtattatacgg

SEQ ID NO: 2943 - DNA, 60 bp, Homo sapiens
tatgtatttatatatgattaccattatgtcgagatagagtatgtaatcattttatgattt

SEQ ID NO: 2944 - DNA, 60 bp, Homo sapiens
ttatatcagtatcaaaataaaacttatttcgataaaaaataatgaaacaaatgcttttgc

SEQ ID NO: 2945 - DNA, 60 bp, Homo sapiens
tttattgattttttactatttttttttttcgaaattcatcagtactttgtaaaatggaat

SEQ ID NO: 2946 - DNA, 60 bp, Homo sapiens
tgaggcgggtctttatctccacagtgcctcgagcaaaagcttactttttcagaaaagaaa

SEQ ID NO: 2947 - DNA, 60 bp, Homo sapiens
ttcttgactttaattaaagtagttgttctcgaatgtggagcatcatttgcatttctttct

SEQ ID NO: 2948 - DNA, 60 bp, Homo sapiens
tagttaaaagtgaagaaaaggaaacttttcgatgtacttttccatttgtttacgtacatg

SEQ ID NO: 2949 - DNA, 60 bp, Homo sapiens
tctttactaaagagaatctatcttgtattcgaataagattatctcctttatacatctatt

SEQ ID NO: 2950 - DNA, 60 bp, Homo sapiens
tggctgaattaatttttttaaacatgattcgatctagaaattcacaggaaaatttcttga

SEQ ID NO: 2951 - DNA, 60 bp, Homo sapiens
tattcatataaggaaagaaagaaaaatctcgatccatttttcctttctttatgtaactgg

SEQ ID NO: 2952 - DNA, 60 bp, Homo sapiens
ccttatttaaaaagaaatattaggaatttcgacactattatctaaagtatattccatact

SEQ ID NO: 2953 - DNA, 60 bp, Homo sapiens
atggtaaatgacttgtatttattagatatcgattagaacaggaatcctgtttatgttaat

SEQ ID NO: 2954 - DNA, 60 bp, Homo sapiens
tctctaaaaacagaaatatcttactttttcgaaaaagatatataaagcaataattaacag

SEQ ID NO: 2955 - DNA, 60 bp, Homo sapiens
tttattttatttttattatttgaaattctcgagaagttctctatatcctaattcccctct

SEQ ID NO: 2956 - DNA, 60 bp, Homo sapiens
aagcatatatatatatattgaataagtgtcgatatagacaatatgaaaacagactatata

SEQ ID NO: 2957 - DNA, 60 bp, Homo sapiens
gaggcgggtgattcacaaggtcagatgttcgataattctggatttgagcttgttacagat

SEQ ID NO: 2958 - DNA, 60 bp, Homo sapiens
atgctaaattatgtaaaatggaatatgttcgattcttatcaattgaagattgaaaaggtg

SEQ ID NO: 2959 - DNA, 60 bp, Homo sapiens
aatgtaaaatatcactaatatttctctatcgatatgtaacattgaacagttccaaatgag

SEQ ID NO: 2960 - DNA, 60 bp, Homo sapiens
acttcatttttttatttgagatagagtctcgacagaacctatacatataacagtgcatct

SEQ ID NO: 2961 - DNA, 60 bp, Homo sapiens
tttaatgaatattaaataacaacaaatatcgaagcatcctgtagtctaaaaataaacact

SEQ ID NO: 2962 - DNA, 60 bp, Homo sapiens
atttttaatttaatatttgttttgtctctcgaaaacagtgatttttgtaaaggaaatatt

SEQ ID NO: 2963 - DNA, 60 bp, Homo sapiens
tttactattgaataactaatcaaattcatcgaatatatctattactcgctgtactaaagg

SEQ ID NO: 2964 - DNA, 60 bp, Homo sapiens
atgaattaaaaatattcttcaaatcttatcgaacagcttattttttccttgtatgacata

SEQ ID NO: 2965 - DNA, 60 bp, Homo sapiens
ttctcatgtttctttttctgactaaatgtcgaattagtctctattctagctttacttgag

SEQ ID NO: 2966 - DNA, 60 bp, Homo sapiens
aattcagacccctggtactcaggggtcttcgacagctgagagcagtatttaaaaatttct

SEQ ID NO: 2967 - DNA, 60 bp, Homo sapiens
attatatattctaacttggaattttatttcgactgtataataaaacaggacttttagcaa

SEQ ID NO: 2968 - DNA, 60 bp, Homo sapiens
gaagcaggcagatcatgaggtcagaagatcgatggatgaatggataaacaagatgtagtg

SEQ ID NO: 2969 - DNA, 60 bp, Homo sapiens
tttttcatctatatttattctacataaatcgaattcatctattttccaccattatctatc

SEQ ID NO: 2970 - DNA, 60 bp, Homo sapiens
aatccagtttttggttttgttagtaatctcgattatataaatcctagctagcagataaac

SEQ ID NO: 2971 - DNA, 60 bp, Homo sapiens
agtgtaggaatgaaaacaaaaagtaatgtcgagtcattaattcttgcttcttaactgctt

SEQ ID NO: 2972 - DNA, 60 bp, Homo sapiens
tcataatgagtaacaatgtataaaaatatcgaaaccctgctttattttatttattttttt

SEQ ID NO: 2973 - DNA, 60 bp, Homo sapiens
tattttacaataatcttcttaagtaatgtcgagtaaaatttatgttccatgaaaaaaatc

SEQ ID NO: 2974 - DNA, 60 bp, Homo sapiens
ttcatgagtcatagtcaattatataatctcgattactcagagctgtaaaataccttggct

SEQ ID NO: 2975 - DNA, 60 bp, Homo sapiens
tgtcttgaggcttactagtgcactcccgtcgatcagaagatataaatctgggccgaagta

SEQ ID NO: 2976 - DNA, 60 bp, Homo sapiens
taagattatagaagttacagtgcatacttcgaacccttttgtttataagtatatttgaga

SEQ ID NO: 2977 - DNA, 60 bp, Homo sapiens
tctacttgtgcacataatttaaatcatatcgaaggaaaaaattgatatacagaatgaagc

SEQ ID NO: 2978 - DNA, 60 bp, Homo sapiens
gtcaggcagatcactctaggtcaggagttcgatgtccctgtcagaccaggacacgtgggc

SEQ ID NO: 2979 - DNA, 60 bp, Homo sapiens
attctgaagaattatataacctgatatatcgattccctttctttctttattccattagtc

SEQ ID NO: 2980 - DNA, 60 bp, Homo sapiens
aaggcgggtagatcatgagatcaagagatcgaatttctgagctccagcaatccacccatc

SEQ ID NO: 2981 - DNA, 60 bp, Homo sapiens
taacttttgtccatgaatatatatactttcgatgatgttctattaagaacagtgaaaggg

SEQ ID NO: 2982 - DNA, 60 bp, Homo sapiens
attgtttaagccagccagcctatggtattcgatgtaggttcatcaattgtaacaaatgta

SEQ ID NO: 2983 - DNA, 60 bp, Homo sapiens
gaggcgggtgattcacaaggtcagatgttcgaagtaatattttaattatttaatagttta

SEQ ID NO: 2984 - DNA, 60 bp, Homo sapiens; identical to SEQ ID NO: 910

SEQ ID NO: 2985 - DNA, 60 bp, Homo sapiens
atatgtagatatatgttttcaagcaatatcgaaaaatgacttcaaagtcatggatttcac

SEQ ID NO: 2986 - DNA, 60 bp, Homo sapiens
gtatcacccctggccattacattatccatcgaaccaacttcaaataaggcaaacaccaag

SEQ ID NO: 2987 - DNA, 60 bp, Homo sapiens
cctttcaaatttagatttaaaatctatttcgaagtgcttcttttgctcttcaatgattaa

SEQ ID NO: 2988 - DNA, 60 bp, Homo sapiens
aacaatagtgaacatgtattgtttatattcgattactcttccaagaagcttagttgtaac

SEQ ID NO: 2989 - DNA, 60 bp, Homo sapiens
ctatatttatctgtccacatcagtgttatcgaactcctgacgtcaggtgatctacctgcc

SEQ ID NO: 2990 - DNA, 60 bp, Homo sapiens
ggcaggtagatcacctgacgtcaggagttcgatgtacttttccatttgtttacgtacatg

SEQ ID NO: 2991 - DNA, 60 bp, Homo sapiens
aactctgtattttcttttgtaagattcatcgaacattcaaattccctaaagaaaagagag

SEQ ID NO: 2992 - DNA, 60 bp, Homo sapiens; identical to SEQ ID NO: 2973

SEQ ID NO: 2993 - DNA, 60 bp, Homo sapiens
aggaaattataatattgtgattaaaagttcgaagagttaactgtaactttgagaagttaa

SEQ ID NO: 2994 - DNA, 60 bp, Homo sapiens
ccttataatttagttaatgaaaatataatcgaaatgaattacccaaagggaaaataaatg

SEQ ID NO: 2995 - DNA, 60 bp, Homo sapiens
atgcagatatttttcaaccaaacgaggatcgaggccgcagtaagctgtgttcacaccact

SEQ ID NO: 2996 - DNA, 60 bp, Homo sapiens
gacaggtggatcatctaatgtcaggagttcgatttgctatttggagagcaatgaaactga

SEQ ID NO: 2997 - DNA, 60 bp, Homo sapiens
gacaggtggatcatctaatgtcaggagttcgacccatcagatgttactgaggaaacacag

SEQ ID NO: 2998 - DNA, 60 bp, Homo sapiens
aggtgggtggatccacgatgtcaggagatcgatctggatacacctggaaagaccgttatt

SEQ ID NO: 2999 - DNA, 60 bp, Homo sapiens
catttaatagatactcagtaaatgtttgtcgatctgttagtaaacagtgtctagtagtca

SEQ ID NO: 3000 - DNA, 60 bp, Homo sapiens
tatatacatatttttaagaaaaacagtatcgatgaagcaatattcttccatcttcaattt

SEQ ID NO: 3001 - DNA, 60 bp, Homo sapiens
agattactcaaaaatttttttagaattctcgattcttatatgatatacatctctcctgga

SEQ ID NO: 3002 - DNA, 25 bp, Homo sapiens
atcaggcgtgcttgtgaggttgtgc

SEQ ID NO: 3003 - DNA, 23 bp, Homo sapiens
gaaaatcccttgagcctcggagc

SEQ ID NO: 3004 - DNA, 23 bp, Homo sapiens
cccagcactttggtaatcccagc

SEQ ID NO: 3005 - DNA, 26 bp, Homo sapiens
actttatcttgtagagacacggctat

SEQ ID NO: 3006 - DNA, 23 bp, Homo sapiens
ggtgaaaccccatctctaccaaa

SEQ ID NO: 3007 - DNA, 26 bp, Homo sapiens
gctcagtaaagccctgtgttgtggaa

SEQ ID NO: 3008 - DNA, 23 bp, Homo sapiens
cgcctgtaatcccaccactttgg

SEQ ID NO: 3009 - DNA, 23 bp, Homo sapiens
cgcctgtaatcccaccactttgg

SEQ ID NO: 3010 - DNA, 26 bp, Homo sapiens
taccagggctgagggtgttgtcctat

SEQ ID NO: 3011 - DNA, 23 bp, Homo sapiens
tgtatgtgtggctgggcgtagtg

SEQ ID NO: 3012 - DNA, 23 bp, Homo sapiens
tgccagtaatcccagaactttgg

SEQ ID NO: 3013 - DNA, 26 bp, Homo sapiens
tgtatgtgtggctgggcgtagtggtt

SEQ ID NO: 3014 - DNA, 23 bp, Homo sapiens
tccaaagtgctgggattacaggc

SEQ ID NO: 3015 - DNA, 23 bp, Homo sapiens
gcataaaagagccacctgccagc

SEQ ID NO: 3016 - DNA, 26 bp, Homo sapiens
tccagcataaaagagccacctgccag

SEQ ID NO: 3017 - DNA, 23 bp, Homo sapiens
ggagaaggttccagaagccgcct

SEQ ID NO: 3018 - DNA, 26 bp, Homo sapiens
ttcccatcctctgctatttggttacc

SEQ ID NO: 3019 - DNA, 26 bp, Homo sapiens
gaactacttcacgggagagattactc

SEQ ID NO: 3020 - DNA, 25 bp, Homo sapiens
attgtcttccattttcttctgctta

SEQ ID NO: 3021 - DNA, 24 bp, Homo sapiens
ggcattctgagggcaagaggtgtg

SEQ ID NO: 3022 - DNA, 25 bp, Homo sapiens
ttttgtcattatttggtcatttcac

SEQ ID NO: 3023 - DNA, 23 bp, Homo sapiens
gctaacaggacacacccagtgcc

SEQ ID NO: 3024 - DNA, 26 bp, Homo sapiens
tgccacagcaagtctatcagcatccg

SEQ ID NO: 3025 - DNA, 25 bp, Homo sapiens
acttgtcttttctcattctctaaca

SEQ ID NO: 3026 - DNA, 23 bp, Homo sapiens
tagcctgttcctgcccctctctg

SEQ ID NO: 3027 - DNA, 23 bp, Homo sapiens
taaccctcacaaccacccaggag

SEQ ID NO: 3028 - DNA, 26 bp, Homo sapiens
actttatcttgtagagacacggctat

SEQ ID NO: 3029 - DNA, 23 bp, Homo sapiens
cgcctgtaaccccagcattttgg

SEQ ID NO: 3030 - DNA, 26 bp, Homo sapiens
gaataacccaagttcacagcaatggt

SEQ ID NO: 3031 - DNA, 26 bp, Homo sapiens
caactgacatctttcaactctgggag

SEQ ID NO: 3032 - DNA, 23 bp, Homo sapiens
gagagcgttgggctttgtccagc

SEQ ID NO: 3033 - DNA, 26 bp, Homo sapiens
ctattcaccttgactttggcagcact

SEQ ID NO: 3034 - DNA, 26 bp, Homo sapiens
cactaagggtctgtcactgaaaggct

SEQ ID NO: 3035 - DNA, 23 bp, Homo sapiens
ctgggcaacagtgcgagactctg

SEQ ID NO: 3036 - DNA, 23 bp, Homo sapiens
agtggctcacacctgtaatcccg

SEQ ID NO: 3037 - DNA, 23 bp, Homo sapiens
taataccagcactttgggaggct

SEQ ID NO: 3038 - DNA, 23 bp, Homo sapiens
agcctgggtgacagagtaagact

SEQ ID NO: 3039 - DNA, 24 bp, Homo sapiens
attctgagggcaagaggtgtgaga

SEQ ID NO: 3040 - DNA, 23 bp, Homo sapiens
agcctgggcaacagagtgagact

SEQ ID NO: 3041 - DNA, 23 bp, Homo sapiens
caggcaccacaccacaagcactg

SEQ ID NO: 3042 - DNA, 23 bp, Homo sapiens
aagaaggctgggtgtccaagcag

SEQ ID NO: 3043 - DNA, 23 bp, Homo sapiens
cgtgcccagccaagatgactttt

SEQ ID NO: 3044 - DNA, 26 bp, Homo sapiens
tctgccacagcaagtctatcagcatc

SEQ ID NO: 3045 - DNA, 24 bp, Homo sapiens
caggaatcatttgacacaatcccc

SEQ ID NO: 3046 - DNA, 26 bp, Homo sapiens
aaaggttcttgccacattccgcccca

SEQ ID NO: 3047 - DNA, 23 bp, Homo sapiens
ttcttgccacattccgccccagc

SEQ ID NO: 3048 - DNA, 26 bp, Homo sapiens
gagttggcagggaaatggacaaggtc

SEQ ID NO: 3049 - DNA, 26 bp, Homo sapiens
aagccttcccacaaagaaaactcagg

SEQ ID NO: 3050 - DNA, 26 bp, Homo sapiens
cttggctgccttcctacacagggtat

SEQ ID NO: 3051 - DNA, 23 bp, Homo sapiens
gtcaagagaggcacggtggctca

SEQ ID NO: 3052 - DNA, 23 bp, Homo sapiens
gcgagtttgcctggtggtctctc

SEQ ID NO: 3053 - DNA, 26 bp, Homo sapiens
aggctcctgggttcctatgttcaaat

SEQ ID NO: 3054 - DNA, 23 bp, Homo sapiens
ctcctacaaagcaaaggctgagg

SEQ ID NO: 3055 - DNA, 26 bp, Homo sapiens
atacagccacttcaacttgtcctaat

SEQ ID NO: 3056 - DNA, 24 bp, Homo sapiens
agaagagattgataaggttgtgta

SEQ ID NO: 3057 - DNA, 25 bp, Homo sapiens
cagaataaatgtgtcccagatgacg

SEQ ID NO: 3058 - DNA, 25 bp, Homo sapiens
tccagtagtctgtgagcatctccat

SEQ ID NO: 3059 - DNA, 26 bp, Homo sapiens
cccttattcattcatccagaaaacca

SEQ ID NO: 3060 - DNA, 24 bp, Homo sapiens
ataaataggtaagaaaagaacagc

SEQ ID NO: 3061 - DNA, 23 bp, Homo sapiens
gctgtgtctctcccaggtaggct

SEQ ID NO: 3062 - DNA, 26 bp, Homo sapiens
gttttgctgtagttttgctgaagttc

SEQ ID NO: 3063 - DNA, 20 bp, Homo sapiens
acatatattaatataataat

SEQ ID NO: 3064 - DNA, 23 bp, Homo sapiens
aacaccttagcaatactgtcccc

SEQ ID NO: 3065 - DNA, 26 bp, Homo sapiens
ctcaagttgtcacagcattaccacct

SEQ ID NO: 3066 - DNA, 26 bp, Homo sapiens
ctatttcctcccctcaccttccactc

SEQ ID NO: 3067 - DNA, 26 bp, Homo sapiens
ccccaggcagtcctattagaaaatgt

SEQ ID NO: 3068 - DNA, 26 bp, Homo sapiens
gccacccaaagactgtaagacaaatc

SEQ ID NO: 3069 - DNA, 26 bp, Homo sapiens
gtgtgtgtgttcactatttctgactc

SEQ ID NO: 3070 - DNA, 24 bp, Homo sapiens
atgagagaaacaaaaccccacata

SEQ ID NO: 3071 - DNA, 23 bp, Homo sapiens
caaatggtggtggagcaacgggt

SEQ ID NO: 3072 - DNA, 23 bp, Homo sapiens
catctctcactaccaggaccagc

SEQ ID NO: 3073 - DNA, 26 bp, Homo sapiens
gccctcttagattgatgccagaagta

SEQ ID NO: 3074 - DNA, 26 bp, Homo sapiens
cagaagggacaacaaacaatccagtc

SEQ ID NO: 3075 - DNA, 23 bp, Homo sapiens
agtccagaccttgccacaacccc

SEQ ID NO: 3076 - DNA, 26 bp, Homo sapiens
tgcctcacacagagtagacaatacat

SEQ ID NO: 3077 - DNA, 23 bp, Homo sapiens
cgcctgtaaccccagcattttgg

SEQ ID NO: 3078 - DNA, 26 bp, Homo sapiens
ggcaaaacaacttcccactgacctgt

SEQ ID NO: 3079 - DNA, 25 bp, Homo sapiens
atctgaactgaaatgtatgtaagta

SEQ ID NO: 3080 - DNA, 23 bp, Homo sapiens
ggtcgtgagcccttgagagtgac

SEQ ID NO: 3081 - DNA, 26 bp, Homo sapiens
tcctgggaaagcgtttgctaacatta

SEQ ID NO: 3082 - DNA, 26 bp, Homo sapiens
tgtagatgactctctttgtcccctca

SEQ ID NO: 3083 - DNA, 26 bp, Homo sapiens
gggagaaaatacaacatacagatgac

SEQ ID NO: 3084 - DNA, 23 bp, Homo sapiens
ctctgagtgttcacgcctggctc

SEQ ID NO: 3085 - DNA, 25 bp, Homo sapiens
ctattttcacatcatcttgtaagtt

SEQ ID NO: 3086 - DNA, 26 bp, Homo sapiens
gcgagcagccactcagcattacacta

SEQ ID NO: 3087 - DNA, 23 bp, Homo sapiens
gccaggtatgtcaggctccagag

SEQ ID NO: 3088 - DNA, 23 bp, Homo sapiens
ggctcacgcctgtaatcccagta

SEQ ID NO: 3089 - DNA, 26 bp, Homo sapiens
gggcagaagatggaaaagaacaagtg

SEQ ID NO: 3090 - DNA, 25 bp, Homo sapiens
ttttcttgttcaatactgctactac

SEQ ID NO: 3091 - DNA, 23 bp, Homo sapiens
gtgtctggcacaagaaagggctc

SEQ ID NO: 3092 - DNA, 23 bp, Homo sapiens
ccaacaatctctcccctcactgc

SEQ ID NO: 3093 - DNA, 26 bp, Homo sapiens
agaaagaggagggtgggattttaggg

SEQ ID NO: 3094 - DNA, 26 bp, Homo sapiens
gtaacgatttcccaagtggtccccaa

SEQ ID NO: 3095 - DNA, 26 bp, Homo sapiens
aggctcctgggttcctatgttcaaat

SEQ ID NO: 3096 - DNA, 26 bp, Homo sapiens
ggcatacaagtaggataccaagcaga

SEQ ID NO: 3097 - DNA, 25 bp, Homo sapiens
tcccatttccaactcttctgataaa

SEQ ID NO: 3098 - DNA, 23 bp, Homo sapiens
tgcctgtaatcccagcactttgg

SEQ ID NO: 3099 - DNA, 26 bp, Homo sapiens
acccaaaccttcctttctccacagag

SEQ ID NO: 3100 - DNA, 23 bp, Homo sapiens
cacctgtaatcccagcactttgg

SEQ ID NO: 3101 - DNA, 26 bp, Homo sapiens
aatccatctgcctcatttccctcccc

SEQ ID NO: 3102 - DNA, 26 bp, Homo sapiens
ccatctactaaccagaaagacagccc

SEQ ID NO: 3103 - DNA, 23 bp, Homo sapiens
cgcctgtaaccccagcattttgg

SEQ ID NO: 3104 - DNA, 26 bp, Homo sapiens
acacatccactgataggcaacaactg

SEQ ID NO: 3105 - DNA, 26 bp, Homo sapiens
gttcctcttgctccacttgtcaacag

SEQ ID NO: 3106 - DNA, 23 bp, Homo sapiens
gcataaaagagccacctgccagc

SEQ ID NO: 3107 - DNA, 24 bp, Homo sapiens
ttactggtgtcttttatgaacaaa

SEQ ID NO: 3108 - DNA, 23 bp, Homo sapiens
gccacctcacccagactatttta

SEQ ID NO: 3109 - DNA, 26 bp, Homo sapiens
gccaacatctctctctatctaaatct

SEQ ID NO: 3110 - DNA, 25 bp, Homo sapiens
tcagtgggatgtgagaaagccaata

SEQ ID NO: 3111 - DNA, 26 bp, Homo sapiens
cccagaaagatggatgagtagaaaat

SEQ ID NO: 3112 - DNA, 26 bp, Homo sapiens
agaaagaggagggtgggattttaggg

SEQ ID NO: 3113 - DNA, 26 bp, Homo sapiens
gctgtttgttttgtttgggagagtaa

SEQ ID NO: 3114 - DNA, 24 bp, Homo sapiens
gagaagagattgataaggttgtgt

SEQ ID NO: 3115 - DNA, 25 bp, Homo sapiens
cagtttacccttgaacagcaaatgc

SEQ ID NO: 3116 - DNA, 23 bp, Homo sapiens
atgaaggaagggctcttggctgg

SEQ ID NO: 3117 - DNA, 23 bp, Homo sapiens
atgaaggaagggctcttggctgg

SEQ ID NO: 3118 - DNA, 26 bp, Homo sapiens
tgtcaagagaggcacggtggctcata

SEQ ID NO: 3119 - DNA, 26 bp, Homo sapiens
cgtgtccaggtatttagtggcagaaa

SEQ ID NO: 3120 - DNA, 24 bp, Homo sapiens
tgaatgaatgagtctgttggaaat

SEQ ID NO: 3121 - DNA, 26 bp, Homo sapiens
cctggaagtttgaggacagtttggac

SEQ ID NO: 3122 - DNA, 26 bp, Homo sapiens
tcctctgagactgctttatggtatct

SEQ ID NO: 3123 - DNA, 23 bp, Homo sapiens
cgtgtaacagggcagcatctggg

SEQ ID NO: 3124 - DNA, 23 bp, Homo sapiens
ggaaggttctgagccgagaggag

SEQ ID NO: 3125 - DNA, 23 bp, Homo sapiens
ttgctcaggctggaatgcggtgg

SEQ ID NO: 3126 - DNA, 26 bp, Homo sapiens
cttgaacaaatggatgtggctgtgta

SEQ ID NO: 3127 - DNA, 26 bp, Homo sapiens
gagcaaaagaagccaatgcgaaggta

SEQ ID NO: 3128 - DNA, 24 bp, Homo sapiens
gtcacttgtgctaaatgccacttc

SEQ ID NO: 3129 - DNA, 23 bp, Homo sapiens
aaggattgcttgagcccaggaat

SEQ ID NO: 3130 - DNA, 26 bp, Homo sapiens
ggatactaactgtgctactttggagc

SEQ ID NO: 3131 - DNA, 23 bp, Homo sapiens
cagtagtctcccctcaccctgga

SEQ ID NO: 3132 - DNA, 26 bp, Homo sapiens
catcgtctttggttttgatagtgaag

SEQ ID NO: 3133 - DNA, 26 bp, Homo sapiens
cccgacataaatacaggcaacatcta

SEQ ID NO: 3134 - DNA, 26 bp, Homo sapiens
cctttccccaaacaaacttattcctt

SEQ ID NO: 3135 - DNA, 23 bp, Homo sapiens
cccaaactccaaaggcagcgtgc

SEQ ID NO: 3136 - DNA, 26 bp, Homo sapiens
ggcaaaagcaatgagaatccaatcag

SEQ ID NO: 3137 - DNA, 23 bp, Homo sapiens
gcgtccaatcagaacttgcgagc

SEQ ID NO: 3138 - DNA, 23 bp, Homo sapiens
gcttgggtctggaaaggcaggac

SEQ ID NO: 3139 - DNA, 26 bp, Homo sapiens
gactgtggaaataaggatgaaagaag

SEQ ID NO: 3140 - DNA, 25 bp, Homo sapiens
tcttgcctatgttttgttgtatcat

SEQ ID NO: 3141 - DNA, 23 bp, Homo sapiens
gcctgccttggtgaaactgacct

SEQ ID NO: 3142 - DNA, 24 bp, Homo sapiens
gtaatactctcattttagaagcaa

SEQ ID NO: 3143 - DNA, 23 bp, Homo sapiens
acccacccacacagatacccgta

SEQ ID NO: 3144 - DNA, 26 bp, Homo sapiens
gttccatcatagcaggattgggtcat

SEQ ID NO: 3145 - DNA, 25 bp, Homo sapiens
attttgctgtgtttcccaagcctta

SEQ ID NO: 3146 - DNA, 23 bp, Homo sapiens
ggactcagactgcctggctttga

SEQ ID NO: 3147 - DNA, 23 bp, Homo sapiens
ccttgggaagccatactcacccc

SEQ ID NO: 3148 - DNA, 23 bp, Homo sapiens
ttgctcaggctggaatgcggtgg

SEQ ID NO: 3149 - DNA, 26 bp, Homo sapiens
aagatacaccaagcacaagtccaaat

SEQ ID NO: 3150 - DNA, 26 bp, Homo sapiens
cttcagtttggagcaacaccttcacg

SEQ ID NO: 3151 - DNA, 26 bp, Homo sapiens
tcgtgtgctacctgaactctgggaca

SEQ ID NO: 3152 - DNA, 23 bp, Homo sapiens
cgttggaagagatggctccgatg

SEQ ID NO: 3153 - DNA, 26 bp, Homo sapiens
ggcaccaagtagcccacagtattacc

SEQ ID NO: 3154 - DNA, 26 bp, Homo sapiens
gcctaccaaacagccctgagaaagat

SEQ ID NO: 3155 - DNA, 25 bp, Homo sapiens
gccaccacagtaaccaaagaaatct

SEQ ID NO: 3156 - DNA, 26 bp, Homo sapiens
gggcattcatagttgctttgtttgta

SEQ ID NO: 3157 - DNA, 23 bp, Homo sapiens
cacctgtaatcccagcactttgg

SEQ ID NO: 3158 - DNA, 26 bp, Homo sapiens
gagacacacaataaaacaactgactc

SEQ ID NO: 3159 - DNA, 25 bp, Homo sapiens
gtgaaaacaataatacatactcttg

SEQ ID NO: 3160 - DNA, 23 bp, Homo sapiens
ggacaggtaactacgggtctccc

SEQ ID NO: 3161 - DNA, 23 bp, Homo sapiens
ccccttcctctcacccaaagttc

SEQ ID NO: 3162 - DNA, 23 bp, Homo sapiens
tgggctgaggttccacagagcag

SEQ ID NO: 3163 - DNA, 23 bp, Homo sapiens
ctctaagccaagtgctaatgagc

SEQ ID NO: 3164 - DNA, 26 bp, Homo sapiens
gaaaataacagttctcaggaaggcat

SEQ ID NO: 3165 - DNA, 23 bp, Homo sapiens
ctccacttctaccaccacgagta

SEQ ID NO: 3166 - DNA, 26 bp, Homo sapiens
atttattccattaccttgggcacccc

SEQ ID NO: 3167 - DNA, 23 bp, Homo sapiens
ctaccctgctttctgctggagtc

SEQ ID NO: 3168 - DNA, 26 bp, Homo sapiens
gaggctgtttccactaccacataaaa

SEQ ID NO: 3169 - DNA, 26 bp, Homo sapiens
aagattcctgctgggctccatcctca

SEQ ID NO: 3170 - DNA, 26 bp, Homo sapiens
acataaaagggagtgcctgactaacg

SEQ ID NO: 3171 - DNA, 23 bp, Homo sapiens
accataagtgggtccctgtcacg

SEQ ID NO: 3172 - DNA, 24 bp, Homo sapiens
tcctttcctgagagagtagggata

SEQ ID NO: 3173 - DNA, 26 bp, Homo sapiens
ggaaagcagaaaagacatcacaaacc

SEQ ID NO: 3174 - DNA, 26 bp, Homo sapiens
aaaccccacaatgagaccttctaaat

SEQ ID NO: 3175 - DNA, 26 bp, Homo sapiens
gagccaggcacttggattagcaaaat

SEQ ID NO: 3176 - DNA, 25 bp, Homo sapiens
aaatgtgactctaaagttatcctgc

SEQ ID NO: 3177 - DNA, 23 bp, Homo sapiens
agcccacactcccgttttctgta

SEQ ID NO: 3178 - DNA, 25 bp, Homo sapiens
taacagaaaagaaagaaataaaggg

SEQ ID NO: 3179 - DNA, 26 bp, Homo sapiens
tgggaaagaaaggacctgtgagtgtc

SEQ ID NO: 3180 - DNA, 24 bp, Homo sapiens
tgatgaacgcctgggtttcttcca

SEQ ID NO: 3181 - DNA, 23 bp, Homo sapiens
gcaccatcaggcttctgggaatg

SEQ ID NO: 3182 - DNA, 24 bp, Homo sapiens
tatgtctgctgcctctgtgctgtc

SEQ ID NO: 3183 - DNA, 22 bp, Homo sapiens
ttgtatttaaaaatagttcttt

SEQ ID NO: 3184 - DNA, 26 bp, Homo sapiens
ctctaaaacagggatgataatggcat

SEQ ID NO: 3185 - DNA, 26 bp, Homo sapiens
gtttctgctcttcatctggacagggc

SEQ ID NO: 3186 - DNA, 26 bp, Homo sapiens
tgggcaagtttgactggacattttct

SEQ ID NO: 3187 - DNA, 26 bp, Homo sapiens
tagggctgcgtggtgttccattgtgt

SEQ ID NO: 3188 - DNA, 26 bp, Homo sapiens
cagtgtctctgacgcacaaatgccta

SEQ ID NO: 3189 - DNA, 26 bp, Homo sapiens
gcctctggctgtaatggataatctcc

SEQ ID NO: 3190 - DNA, 25 bp, Homo sapiens
gaaagacagaacatagaaaacagag

SEQ ID NO: 3191 - DNA, 25 bp, Homo sapiens
caacaaccttttcctcacacgcaaa

SEQ ID NO: 3192 - DNA, 26 bp, Homo sapiens
gcattattgggacacattattaggac

SEQ ID NO: 3193 - DNA, 24 bp, Homo sapiens
tccagaggagaggaagtgccacat

SEQ ID NO: 3194 - DNA, 26 bp, Homo sapiens
gtcaagtttgtggattgtgttggtca

SEQ ID NO: 3195 - DNA, 23 bp, Homo sapiens
gcacgctcctggtgagataagca

SEQ ID NO: 3196 - DNA, 26 bp, Homo sapiens
caccaccagaaaaccagaaagcaccc

SEQ ID NO: 3197 - DNA, 25 bp, Homo sapiens
gaggacaacaagaagtcggctaata

SEQ ID NO: 3198 - DNA, 26 bp, Homo sapiens
tgagcattcaaatctcctaatcacct

SEQ ID NO: 3199 - DNA, 25 bp, Homo sapiens
cagtgtaacctttattttccacaaa

SEQ ID NO: 3200 - DNA, 23 bp, Homo sapiens
ccctcctggtgagaagtcatctg

SEQ ID NO: 3201 - DNA, 26 bp, Homo sapiens
gacttggaatgccttggacttgctta

SEQ ID NO: 3202 - DNA, 26 bp, Homo sapiens
gctactcggaaacactcagagagcga

SEQ ID NO: 3203 - DNA, 26 bp, Homo sapiens
ctgcctgagttacaacagaatccttt

SEQ ID NO: 3204 - DNA, 23 bp, Homo sapiens
gacaaggattctgcccacaaggc

SEQ ID NO: 3205 - DNA, 24 bp, Homo sapiens
gctaccctatgaacacatttgcct

SEQ ID NO: 3206 - DNA, 26 bp, Homo sapiens
gcaatggctgggaaatagaaggcata

SEQ ID NO: 3207 - DNA, 26 bp, Homo sapiens
gccaacttctcttccaactctaaaat

SEQ ID NO: 3208 - DNA, 26 bp, Homo sapiens
cataatgtttctgaggttcaccaatg

SEQ ID NO: 3209 - DNA, 26 bp, Homo sapiens
gaaaggattagagaagagcaagagtg

SEQ ID NO: 3210 - DNA, 24 bp, Homo sapiens
tagttctgaatgtgtcggtggctg

SEQ ID NO: 3211 - DNA, 23 bp, Homo sapiens
acctccctcgctccaagaccaga

SEQ ID NO: 3212 - DNA, 23 bp, Homo sapiens
gcctgggtgacagagcaaaactc

SEQ ID NO: 3213 - DNA, 26 bp, Homo sapiens
ggtgaaacggacatacgcataaagcg

SEQ ID NO: 3214 - DNA, 26 bp, Homo sapiens
ggatgtgcctctttgggagtgagaaa

SEQ ID NO: 3215 - DNA, 26 bp, Homo sapiens
tgggacaccttctgctgctttcagtg

SEQ ID NO: 3216 - DNA, 26 bp, Homo sapiens
cactttcactctcaggtgtgtcccta

SEQ ID NO: 3217 - DNA, 24 bp, Homo sapiens
tgtgcttggttgaactgaatcatt

SEQ ID NO: 3218 - DNA, 23 bp, Homo sapiens
gctctgctctccctatccttggc

SEQ ID NO: 3219 - DNA, 26 bp, Homo sapiens
gctctgagaaaaggagttagcaagca

SEQ ID NO: 3220 - DNA, 23 bp, Homo sapiens
gtagtcccagcactttaggaggc

SEQ ID NO: 3221 - DNA, 26 bp, Homo sapiens
tgctatgggtggtgacagttgtgtat

SEQ ID NO: 3222 - DNA, 26 bp, Homo sapiens
ctgaaaatccattgactatcttctcg

SEQ ID NO: 3223 - DNA, 26 bp, Homo sapiens
ctgaaaacctaaaagggaactgaaca

SEQ ID NO: 3224 - DNA, 26 bp, Homo sapiens
tatgttacaccccttggctacccagc

SEQ ID NO: 3225 - DNA, 26 bp, Homo sapiens
gctgtttccttatccaagtctcagat

SEQ ID NO: 3226 - DNA, 23 bp, Homo sapiens
tacggaagatggaagtgaggtgc

SEQ ID NO: 3227 - DNA, 24 bp, Homo sapiens
gatttcattactattgttctaagc

SEQ ID NO: 3228 - DNA, 24 bp, Homo sapiens
cctccaagttctccttttcgttac

SEQ ID NO: 3229 - DNA, 23 bp, Homo sapiens
agcactttgggaggctgaggcag

SEQ ID NO: 3230 - DNA, 26 bp, Homo sapiens
cagtgtctctgacgcacaaatgccta

SEQ ID NO: 3231 - DNA, 26 bp, Homo sapiens
gggaaactgtgactcaacctcaggaa

SEQ ID NO: 3232 - DNA, 26 bp, Homo sapiens
ggtgaaacggacatacgcataaagcg

SEQ ID NO: 3233 - DNA, 26 bp, Homo sapiens
gtgagataactgaggctctaagaact

SEQ ID NO: 3234 - DNA, 24 bp, Homo sapiens
gggcgacaaagtgaaaccctcatt

SEQ ID NO: 3235 - DNA, 23 bp, Homo sapiens
ggactacaggcgtgagccaccac

SEQ ID NO: 3236 - DNA, 23 bp, Homo sapiens
ctatcggagggcgggtcccaata

SEQ ID NO: 3237 - DNA, 23 bp, Homo sapiens
tgaagcctgcccacaaggtcagc

SEQ ID NO: 3238 - DNA, 26 bp, Homo sapiens
aactatctatccgtctgtcttctggc

SEQ ID NO: 3239 - DNA, 26 bp, Homo sapiens
tttcggcagtagccaatcagagaccc

SEQ ID NO: 3240 - DNA, 24 bp, Homo sapiens
taccatcctctgcccttcaacata

SEQ ID NO: 3241 - DNA, 25 bp, Homo sapiens
gggcaaataccatcgctttccccta

SEQ ID NO: 3242 - DNA, 60 bp, Homo sapiens
tttactggtgtagatatgatcttagtactcgactatgtctggattaaaaaatctttgtga

SEQ ID NO: 3243 - DNA, 60 bp, Homo sapiens
aatatatttctaaaatatgtaaatatattcgaatgctggaaaccaatgaaaatattgaaa

SEQ ID NO: 3244 - DNA, 60 bp, Homo sapiens
cttaatcaattggagtttaacctttggttcgatagacgatgtgaacaaatggaatgaact

SEQ ID NO: 3245 - DNA, 60 bp, Homo sapiens
gaaaaaaaataaagaggaaatgaaatattcgagaccagtcttgaaaccctatgtctacta

SEQ ID NO: 3246 - DNA, 60 bp, Homo sapiens
aatagatatacaactggttattgcagcatcgaactcctgacctcaggcagtcaccttctt

SEQ ID NO: 3247 - DNA, 60 bp, Homo sapiens
atgaaaggaaaaattgataaatttttcatcgaacagtaattctgaaattactgtcttata

SEQ ID NO: 3248 - DNA, 60 bp, Homo sapiens
aaatattcttaaaccaaatatttacctatcgactaaagtttctctattacactatttcat

SEQ ID NO: 3249 - DNA, 60 bp, Homo sapiens
gtatcacccctggccattacattatccatcgacctcaattctaaacaagtgcttcttatt

SEQ ID NO: 3250 - DNA, 60 bp, Homo sapiens
actacaaattttatatgcttactgaatatcgataaatcaattggctaagtaagtgattga

SEQ ID NO: 3251 - DNA, 60 bp, Homo sapiens
tcagttctaggaaaattaagttacatcttcgaggttccagagactagaccttgaaatagt

SEQ ID NO: 3252 - DNA, 60 bp, Homo sapiens
aaatgtgtgtgaggggagaaagctttgctcgatagactattaattaaaaaataaactttt

SEQ ID NO: 3253 - DNA, 60 bp, Homo sapiens
aaatgtgtgtgaggggagaaagctttgctcgaaagcaaactgtcagcctttctgggggaa

SEQ ID NO: 3254 - DNA, 60 bp, Homo sapiens
catttttacaaggaaaggactttactcttcgaatctcatttgttttcttagctgagaaaa

SEQ ID NO: 3255 - DNA, 60 bp, Homo sapiens
agattttttttttttaaaatgatttcaatcgaattctattataaacatgaaagtgtctgt

SEQ ID NO: 3256 - DNA, 60 bp, Homo sapiens
aattttgtgttactattctccatcctaatcgatttctctttttccattatccctcatcca

SEQ ID NO: 3257 - DNA, 60 bp, Homo sapiens
cattcttttcgtttgaatttgtctttcctcgaggagcttattttaagtctttttactgag

SEQ ID NO: 3258 - DNA, 60 bp, Homo sapiens
ggtatttcttttatgtatgatatattcttcgaacatgttttagtgatttatattcactca

SEQ ID NO: 3259 - DNA, 60 bp, Homo sapiens
cctaatttctctgagtacaacttccttatcgaactcctgacctcaggttttctacccgcc

SEQ ID NO: 3260 - DNA, 60 bp, Homo sapiens; identical to SEQ ID NO: 200

SEQ ID NO: 3261 - DNA, 60 bp, Homo sapiens
ggaggggtgatcacttaaggtcaggagttcgaactcctgggcccaagcagtctttccacc

SEQ ID NO: 3262 - DNA, 60 bp, Homo sapiens
cctcagcattccattccaatcctttctctcgaacagagaacctactcaaatcctgtgcaa

SEQ ID NO: 3263 - DNA, 60 bp, Homo sapiens
tcataaaataataattaacaaacatacatcgaaaatatttgacatagttgatcacttcct

SEQ ID NO: 3264 - DNA, 60 bp, Homo sapiens
aattgttcattgtggatatttcagcccatcgaagaaaatgctgaagaatatcttaatgac

SEQ ID NO: 3265 - DNA, 60 bp, Homo sapiens
aaagatacaataattctaaattaaagcttcgactttaactatgattatatcattgcacaa

SEQ ID NO: 3266 - DNA, 60 bp, Homo sapiens
aattgttcattgtggatatttcagcccatcgatcttaacattcaaaatcaaaaccttgac

SEQ ID NO: 3267 - DNA, 60 bp, Homo sapiens
taaacacatttttaaaaaagatacatgatcgacgtatattcagtccaaaaaaaaaaaaaa

SEQ ID NO: 3268 - DNA, 60 bp, Homo sapiens
aatctctatcatgatataaatttataagtcgaaaaacaaaaataataaatgcaatattga

SEQ ID NO: 3269 - DNA, 60 bp, Homo sapiens
gggcgcgggtctgcggagcccccagggctcgaaacctgtctggccaacatggcaaaactc

SEQ ID NO: 3270 - DNA, 60 bp, Homo sapiens
gccccaggtgtgttgtgtttgtttcatgtcgactgattgatcaatttagtccttcttgag

SEQ ID NO: 3271 - DNA, 60 bp, Homo sapiens
cctcagcattccattccaatcctttctctcgagttcaggaaattctcttctattcccagt

SEQ ID NO: 3272 - DNA, 60 bp, Homo sapiens
cttaatcaattggagtttaacctttggttcgatttataacaaaaataaacactgtagaaa

SEQ ID NO: 3273 - DNA, 60 bp, Homo sapiens
gccccaggtgtgttgtgtttgtttcatgtcgaaacattactcatccaccaacaccttggc

SEQ ID NO: 3274 - DNA, 60 bp, Homo sapiens
tttcttgtatttcattatgtacatctattcgagttttatataaattcaatcatatttaag

SEQ ID NO: 3275 - DNA, 60 bp, Homo sapiens
aagttacaggcgtcaccaaagtttaggctcgaggccgcagtaagctgtgttcacaccact

SEQ ID NO: 3276 - DNA, 60 bp, Homo sapiens
ccttttatccctgagccattgaaatggttcgaaaccatccttacccctatttaatgtagt

SEQ ID NO: 3277 - DNA, 60 bp, Homo sapiens
atttgagaaataaaatgtttcatttttatcgaaaactattaatttttaaaaatgtaagtg

SEQ ID NO: 3278 - DNA, 60 bp, Homo sapiens
cattcttttcgtttgaatttgtctttcctcgagatgtactttagatgtaaaatacatacc

SEQ ID NO: 3279 - DNA, 60 bp, Homo sapiens
cagtaatcctagaaagacaactgatacatcgattctcggagggtaacattaaatgccaat

SEQ ID NO: 3280 - DNA, 60 bp, Homo sapiens
ctccatagctgatgataggaactgtttatcgatgttagactgaataaagaaaatgtagca

SEQ ID NO: 3281 - DNA, 60 bp, Homo sapiens
aatgtaaaggagtgaatcattcagatattcgaaaaagatatataaagcaataattaacag

SEQ ID NO: 3282 - DNA, 60 bp, Homo sapiens
aaggaacttttggagacatttagtgatatcgaagcattacttttgcctttcaacccatgc

SEQ ID NO: 3283 - DNA, 60 bp, Homo sapiens
ttcttttgtgctaaaatatagaaagtaatcgactaatcaggtaggtctgggtactttcac

SEQ ID NO: 3284 - DNA, 60 bp, Homo sapiens
tgtcttgaggcttactagtgcactcccgtcgagaaatcttcacttttctatgcaagcaca

SEQ ID NO: 3285 - DNA, 60 bp, Homo sapiens
atcactgtgtgcacaggtgtgtgtgctttcgattgggcagtttcacttccatgttccaga

SEQ ID NO: 3286 - DNA, 60 bp, Homo sapiens
aagagaggtggggacattgtgaactgaatcgaacaagtgagggaagttctgggaaatcag

SEQ ID NO: 3287 - DNA, 60 bp, Homo sapiens
aagttctaaggaagaaaagagtctcctttcgagtattctgttcaacattgtatcctaagt

SEQ ID NO: 3288 - DNA, 60 bp, Homo sapiens
acaggtattagggtgtttattttgcttctcgaattatatatcaaagaccataagttctca

SEQ ID NO: 3289 - DNA, 60 bp, Homo sapiens
aatcttttttcataaaatgaagaataactcgatgagtttctgtattcaggattggtgttt

SEQ ID NO: 3290 - DNA, 60 bp, Homo sapiens
ttaaagaaaagcctataatttgaagaattcgattttagtatgacaactaagaacataaaa

SEQ ID NO: 3291 - DNA, 60 bp, Homo sapiens
cctgtgcaaagtatgactctagtaacattcgagatatgactatctttcagagaagcacta

SEQ ID NO: 3292 - DNA, 60 bp, Homo sapiens
catattcctaaaataaattatacatgcttcgataaaaatgtacttcaaaaattggattgg

SEQ ID NO: 3293 - DNA, 60 bp, Homo sapiens
aggcagataacaaaaccatcccaccgcatcgatcttttcatgacgcgttttccttctgtg

SEQ ID NO: 3294 - DNA, 60 bp, Homo sapiens
tataaaaataaaaataatatatgaattatcgagtcctcaataaatatttgccaaaaacca

SEQ ID NO: 3295 - DNA, 60 bp, Homo sapiens
aagagaggtggggacattgtgaactgaatcgaataggatataccaatgtggacttgtctg

SEQ ID NO: 3296 - DNA, 60 bp, Homo sapiens; identical to SEQ ID NO: 2986

SEQ ID NO: 3297 - DNA, 60 bp, Homo sapiens
gtatcacccctggccattacattatccatcgaaagtttaaactgccagccaaactttgtg

SEQ ID NO: 3298 - DNA, 60 bp, Homo sapiens
ggcggatcacctgatgtcagtcaggagttcgatcacattgatttaaattacagggacctt

SEQ ID NO: 3299 - DNA, 60 bp, Homo sapiens
gtttatctgctagctaggatttatataatcgagcatttatatacaatagcaaatcatcca

SEQ ID NO: 3300 - DNA, 60 bp, Homo sapiens
aatttgttcgttaggttaaattaacatatcgattcactagaattttcctatttgatgatt

SEQ ID NO: 3301 - DNA, 60 bp, Homo sapiens; identical to SEQ ID NO: 3273

SEQ ID NO: 3302 - DNA, 60 bp, Homo sapiens
caacttcacaacatgaagtcattcaatatcgattttaggttcctttccccagtcagtcca

SEQ ID NO: 3303 - DNA, 60 bp, Homo sapiens
ctccatagctgatgataggaactgtttatcgagttgtattgtttctattttccattcagt

SEQ ID NO: 3304 - DNA, 60 bp, Homo sapiens
aggcaggtgaatcacttgagatcagagttcgacacagaaaaagagaaatatgagattatg

SEQ ID NO: 3305 - DNA, 60 bp, Homo sapiens
ttcgtctattgagagtttttgacatgaatcgactaaacaagcaagaaaaattaaaaacaa

SEQ ID NO: 3306 - DNA, 60 bp, Homo sapiens
attcacataaaaaacttttttgtgaacatcgatgaacgtggaatatatttcaattttttt

SEQ ID NO: 3307 - DNA, 60 bp, Homo sapiens
actgaaatgtttttttaaatcagtggtgtcgaggtgatgaagtctgatctgtgtcaagcc

SEQ ID NO: 3308 - DNA, 60 bp, Homo sapiens
aataaagaaaaaaatcttctaaaataattcgataactttcttccctgaaagggttaaaaa

SEQ ID NO: 3309 - DNA, 60 bp, Homo sapiens
tctaggagaattctttactccaattacttcgaaattaaggaacctcctactttttacatc

SEQ ID NO: 3310 - DNA, 60 bp, Homo sapiens
aggtaattaagacaagaaagacatttattcgatttctttatcagaagagtaaagcaagca

SEQ ID NO: 3311 - DNA, 60 bp, Homo sapiens
gttctttagtctgaaccttcctttccagtcgaggccgcagtaagctgtgttcacaccact

SEQ ID NO: 3312 - DNA, 60 bp, Homo sapiens
atatgctttttttaaattacaaaacttatcgaaactggtggatccaccaggttgaaggag

SEQ ID NO: 3313 - DNA, 60 bp, Homo sapiens
aagagaggtggggacattgtgaactgaatcgaatggaaaggccctttttagacaactaat

SEQ ID NO: 3314 - DNA, 60 bp, Homo sapiens
gagattttcttaagacggtaattcttaatcgagacttctttttataaccaaataatttta

SEQ ID NO: 3315 - DNA, 60 bp, Homo sapiens
aattatggtaatgtgttctcttcatccttcgaatttagagatgaacacacgttctgcctc

SEQ ID NO: 3316 - DNA, 60 bp, Homo sapiens
tatgttgtcaatttaatctcaaattatctcgatacctattattgtttatcttttttatta

SEQ ID NO: 3317 - DNA, 60 bp, Homo sapiens
aaggcaggcatatcatgaggtcagaagatcgatctttctatggtgcattttcagagatgt

SEQ ID NO: 3318 - DNA, 60 bp, Homo sapiens
aagagaggtggggacattgtgaactgaatcgatgccaaacagctggaactctcaaatcac

SEQ ID NO: 3319 - DNA, 60 bp, Homo sapiens
atttttaattattaaaaaataatgtttttcgattactttactggattgtctcacagaact

SEQ ID NO: 3320 - DNA, 60 bp, Homo sapiens
gtatcacccctggccattacattatccatcgaggtcatcagaggtccacaactttaggga

SEQ ID NO: 3321 - DNA, 60 bp, Homo sapiens
atctatttggcttatgaattacccagtatcgatgaatcaacattttccaaaataatacat

SEQ ID NO: 3322 - DNA, 60 bp, Homo sapiens
catttttacaaggaaaggactttactcttcgacattactttttgttttcattcctacact

SEQ ID NO: 3323 - DNA, 60 bp, Homo sapiens
tttatatttttattttctataacatacctcgatttttacaagaaatttaaaaattagctt

SEQ ID NO: 3324 - DNA, 60 bp, Homo sapiens; identical to SEQ ID NO: 2889

SEQ ID NO: 3325 - DNA, 60 bp, Homo sapiens
taaaactattttaaatgtttttaaagtatcgaaaactaaatctctaatctctaacctttc

SEQ ID NO: 3326 - DNA, 60 bp, Homo sapiens; identical to SEQ ID NO: 3257

SEQ ID NO: 3327 - DNA, 60 bp, Homo sapiens
ctaacataaaataaacctcttacaaatttcgatgatgttcaaaaatagtagattaaacca

SEQ ID NO: 3328 - DNA, 60 bp, Homo sapiens
tcttgtctgaaatcatcaaggcagtacctcgagtctccttttggatattttcttccaaaa

SEQ ID NO: 3329 - DNA, 60 bp, Homo sapiens
tttactggtgtagatatgatcttagtactcgagtggtaatgtaccaatcattcattgatt

SEQ ID NO: 3330 - DNA, 60 bp, Homo sapiens
tgaaaatattgtacttatattaaattaatcgaactcctagtctcaagtgatccacctgtc

SEQ ID NO: 3331 - DNA, 60 bp, Homo sapiens
ctctgcatttattgtaaactatcttaaatcgaagttggtaagttggtttctaaacatttt

SEQ ID NO: 3332 - DNA, 60 bp, Homo sapiens
ggtgggtagatcacctgaggtcaggagttcgaactcctaacctcaggtgatctacccact

SEQ ID NO: 3333 - DNA, 60 bp, Homo sapiens
atttgagaaataaaatgtttcatttttatcgatcatatatatatatatatatatatatac

SEQ ID NO: 3334 - DNA, 60 bp, Homo sapiens
aattcttccctaaggatatttattaacttcgataactacaaagaaactaaaaacgctacc

SEQ ID NO: 3335 - DNA, 60 bp, Homo sapiens
ttatttgaaaacaacgtcaagagaaggctcgatgggaggcatgacagaaattatattaat

SEQ ID NO: 3336 - DNA, 60 bp, Homo sapiens
ggccaagtctttagagagttgtgatcactcgaaggtattaaaatcttcaactaaaatact

SEQ ID NO: 3337 - DNA, 60 bp, Homo sapiens
tttcttgtatttcattatgtacatctattcgattataagctaacattgaaggtattcgta

SEQ ID NO: 3338 - DNA, 60 bp, Homo sapiens
gaggcgggtgattcacaaggtcagatgttcgaaattgtgtaaataagcatttgcagccct

SEQ ID NO: 3339 - DNA, 60 bp, Homo sapiens
ctgcaggtgtgtgcattaaggagcaacttcgagacaatcctggtcaacatggtgaaaccc

SEQ ID NO: 3340 - DNA, 60 bp, Homo sapiens; identical to SEQ ID NO: 2895

SEQ ID NO: 3341 - DNA, 60 bp, Homo sapiens
ggcaggtggatctcttgaggtcagaagttcgagtcaccaaatgaggaatctaaaatagcc

SEQ ID NO: 3342 - DNA, 60 bp, Homo sapiens
aaatgtgtgtgaggggagaaagctttgctcgatttaattgcagtggtcatattagcttcc

SEQ ID NO: 3343 - DNA, 60 bp, Homo sapiens
tgtataccaaataaatcaaataaataaatcgattgagtaggttttatgttgattggttgg

SEQ ID NO: 3344 - DNA, 60 bp, Homo sapiens
taatctcctcaagtataccataaattattcgaccaggagtaaacatagttaaatgaataa

SEQ ID NO: 3345 - DNA, 60 bp, Homo sapiens
ctatattgtagctctattttctctaaattcgacaactttacttctatgtattatgatcct

SEQ ID NO: 3346 - DNA, 60 bp, Homo sapiens; identical to SEQ ID NO: 2888

SEQ ID NO: 3347 - DNA, 60 bp, Homo sapiens; identical to SEQ ID NO: 668

SEQ ID NO: 3348 - DNA, 60 bp, Homo sapiens; identical to SEQ ID NO: 200

SEQ ID NO: 3349 - DNA, 60 bp, Homo sapiens
ctgcaggtgtgtgcattaaggagcaacttcgaaaagtccagaatgaactccaaagattga

SEQ ID NO: 3350 - DNA, 60 bp, Homo sapiens
gaagcagagatgttttcagttacaaagctcgacattttgaatatgtgggatccaaatctg

SEQ ID NO: 3351 - DNA, 60 bp, Homo sapiens
tgtaacagatccttaaaaaaaaataaaatcgaattatagctctttataggaaatgttcac

SEQ ID NO: 3352 - DNA, 60 bp, Homo sapiens
aagagaggtggggacattgtgaactgaatcgattgctgtccatgtccattggcacttggc

SEQ ID NO: 3353 - DNA, 60 bp, Homo sapiens; identical to SEQ ID NO: 340

SEQ ID NO: 3354 - DNA, 60 bp, Homo sapiens
gcccactaaatagtaatattaggatctatcgaaatttaacttgtaactcaagtaaaattg

SEQ ID NO: 3355 - DNA, 60 bp, Homo sapiens
attacccatatacatatcgtatataaaatcgaaacctctattttcaggtagccattatga

SEQ ID NO: 3356 - DNA, 60 bp, Homo sapiens
aagagaggtggggacattgtgaactgaatcgaccccagggtaaaagttagctattctaaa

SEQ ID NO: 3357 - DNA, 60 bp, Homo sapiens
aactaaaatctcccacaagggaaaaccttcgaggccgcagtaagctgtgttcacaccact

SEQ ID NO: 3358 - DNA, 60 bp, Homo sapiens
cgtctttcctttagggcttcatttaacttcgattgttcttttactattattcactcttgg

SEQ ID NO: 3359 - DNA, 60 bp, Homo sapiens
ggctggcagatcacttgaggccagtagttcgaatgaggaatacatgtttatttgaatagc

SEQ ID NO: 3360 - DNA, 60 bp, Homo sapiens
aatatacataaaagttactttttttttttcgaaacttatgtcacagaaaaaaagcagtaa

SEQ ID NO: 3361 - DNA, 60 bp, Homo sapiens
ctatttcaacaaaaaaactcatttaaaatcgaagtatggtttatattatgacattatgtc

SEQ ID NO: 3362 - DNA, 24 bp, Homo sapiens
gtctgaggacccacacaaaggaac

SEQ ID NO: 3363 - DNA, 26 bp, Homo sapiens
gggatgcctgggacataagtcagatg

SEQ ID NO: 3364 - DNA, 26 bp, Homo sapiens
cacagcaacaaaagcaacctggtgtc

SEQ ID NO: 3365 - DNA, 26 bp, Homo sapiens
ggagaatacctacaggcagcccagaa

SEQ ID NO: 3366 - DNA, 23 bp, Homo sapiens
ctgagtggagtagcgtgggtgag

SEQ ID NO: 3367 - DNA, 26 bp, Homo sapiens
ggtggctttgggtttggtgattactt

SEQ ID NO: 3368 - DNA, 26 bp, Homo sapiens
cttccacaatgagaacacagcccttt

SEQ ID NO: 3369 - DNA, 23 bp, Homo sapiens
agagatgcccttcctgactgccc

SEQ ID NO: 3370 - DNA, 23 bp, Homo sapiens
gtgggctttggagttggaccgac

SEQ ID NO: 3371 - DNA, 23 bp, Homo sapiens
ccacagacattggaggttgagtt

SEQ ID NO: 3372 - DNA, 26 bp, Homo sapiens
gcgatacttacgaaaatgaagccagg

SEQ ID NO: 3373 - DNA, 23 bp, Homo sapiens
tagggtgggcacagaagggtggt

SEQ ID NO: 3374 - DNA, 24 bp, Homo sapiens
tttgaaggtcatctcaggaagggc

SEQ ID NO: 3375 - DNA, 26 bp, Homo sapiens
ggtctccaggtctccttagtctcagt

SEQ ID NO: 3376 - DNA, 26 bp, Homo sapiens
gaaaataacagttctcaggaaggcat

SEQ ID NO: 3377 - DNA, 23 bp, Homo sapiens
ggcaggagaatcacttgaaccta

SEQ ID NO: 3378 - DNA, 25 bp, Homo sapiens
taagacattgtttagcaacttccaa

SEQ ID NO: 3379 - DNA, 27 bp, Homo sapiens
cttcagaactttgtgacctaaggcaat

SEQ ID NO: 3380 - DNA, 24 bp, Homo sapiens
caggaatcatttgacacaatcccc

SEQ ID NO: 3381 - DNA, 23 bp, Homo sapiens
gggctgctggatactggttagtc

SEQ ID NO: 3382 - DNA, 26 bp, Homo sapiens
ccactacaatccacttccactccact

SEQ ID NO: 3383 - DNA, 23 bp, Homo sapiens
cccgcccacatcctgagaatcct

SEQ ID NO: 3384 - DNA, 26 bp, Homo sapiens
ggctctaatcccctttgaggtgcgaa

SEQ ID NO: 3385 - DNA, 26 bp, Homo sapiens
aactggagtctttctatggcttgaat

SEQ ID NO: 3386 - DNA, 26 bp, Homo sapiens
gctctaatcccctttgaggtgcgaaa

SEQ ID NO: 3387 - DNA, 26 bp, Homo sapiens
ttcgtgctcatacataagcctctggc

SEQ ID NO: 3388 - DNA, 26 bp, Homo sapiens
ggcagataaagaaaatagatgtctcc

SEQ ID NO: 3389 - DNA, 23 bp, Homo sapiens
ttttctctacgccctcccgcccc

SEQ ID NO: 3390 - DNA, 23 bp, Homo sapiens
tcagtatggcggattggtggcgg

SEQ ID NO: 3391 - DNA, 23 bp, Homo sapiens
tccactccattccattccactgc

SEQ ID NO: 3392 - DNA, 23 bp, Homo sapiens
cagcaccagcaaccacagcaaca

SEQ ID NO: 3393 - DNA, 23 bp, Homo sapiens
agtatggcggattggtggcgggc

SEQ ID NO: 3394 - DNA, 24 bp, Homo sapiens
tcagtgtttgcttttcccttgaat

SEQ ID NO: 3395 - DNA, 23 bp, Homo sapiens
gtctgttccacaacctctttctg

SEQ ID NO: 3396 - DNA, 26 bp, Homo sapiens
caaccaatccagaacccataccacca

SEQ ID NO: 3397 - DNA, 26 bp, Homo sapiens
cccactggagcataagatgaaccaat

SEQ ID NO: 3398 - DNA, 24 bp, Homo sapiens
tgaggcaggagaatcacttgaacc

SEQ ID NO: 3399 - DNA, 23 bp, Homo sapiens
cgggaggtttctgtgagaggtgt

SEQ ID NO: 3400 - DNA, 26 bp, Homo sapiens
tctgattctcttcattgctcggaaat

SEQ ID NO: 3401 - DNA, 26 bp, Homo sapiens
ccaagaaagtgacatttgaggagaga

SEQ ID NO: 3402 - DNA, 26 bp, Homo sapiens
atgctcaagaagaagtaatgccaggg

SEQ ID NO: 3403 - DNA, 26 bp, Homo sapiens
tccagaagcaggagccaagaaccaca

SEQ ID NO: 3404 - DNA, 26 bp, Homo sapiens
aggctcctgggttcctatgttcaaat

SEQ ID NO: 3405 - DNA, 26 bp, Homo sapiens
tttgaccaggaaacagtgagagcagt

SEQ ID NO: 3406 - DNA, 26 bp, Homo sapiens
tgttgttggacctatctgagcaaagg

SEQ ID NO: 3407 - DNA, 23 bp, Homo sapiens
tggcaacagagcaagactccgtc

SEQ ID NO: 3408 - DNA, 23 bp, Homo sapiens
taaccctcacaaccacccaggag

SEQ ID NO: 3409 - DNA, 26 bp, Homo sapiens
ctaagttcctgtgtgtctgtcttgac

SEQ ID NO: 3410 - DNA, 24 bp, Homo sapiens
cagaatctattaccttggtgagta

SEQ ID NO: 3411 - DNA, 26 bp, Homo sapiens
cccttgtgaaaactgaacaccacccc

SEQ ID NO: 3412 - DNA, 26 bp, Homo sapiens
ggagcctaaagttatgggaatgtcat

SEQ ID NO: 3413 - DNA, 26 bp, Homo sapiens
caaggtggcagttggcagtcagaaag

SEQ ID NO: 3414 - DNA, 23 bp, Homo sapiens
ggtgaggacacagcgaaaccata

SEQ ID NO: 3415 - DNA, 23 bp, Homo sapiens
ggtccttgttggatgtgctgggc

SEQ ID NO: 3416 - DNA, 23 bp, Homo sapiens
gcataaaagagccacctgccagc

SEQ ID NO: 3417 - DNA, 24 bp, Homo sapiens
ccccgcatccagcataaaagagcc

SEQ ID NO: 3418 - DNA, 23 bp, Homo sapiens
aaaagcaacctgggctgggcacg

SEQ ID NO: 3419 - DNA, 23 bp, Homo sapiens
aaaagcaacctgggctgggcacg

SEQ ID NO: 3420 - DNA, 23 bp, Homo sapiens
aaaagcaacctgggctgggcacg

SEQ ID NO: 3421 - DNA, 23 bp, Homo sapiens
agtatggcggattggtggcgggc

SEQ ID NO: 3422 - DNA, 23 bp, Homo sapiens
ggttgggcagacagttcctggga

SEQ ID NO: 3423 - DNA, 26 bp, Homo sapiens
tcatctcagttgctttctgctggagc

SEQ ID NO: 3424 - DNA, 23 bp, Homo sapiens
cgcctgtaatcccagcagtttgg

SEQ ID NO: 3425 - DNA, 23 bp, Homo sapiens
gagacattggctgtgggtttgtt

SEQ ID NO: 3426 - DNA, 24 bp, Homo sapiens
catcatttcccgcccttgtcttta

SEQ ID NO: 3427 - DNA, 23 bp, Homo sapiens
ggcggtttggaggttgggcagtt

SEQ ID NO: 3428 - DNA, 26 bp, Homo sapiens
gcagaaccccttgtaatccccaaata

SEQ ID NO: 3429 - DNA, 26 bp, Homo sapiens
tttctaagcactcagggcaatgtcta

SEQ ID NO: 3430 - DNA, 26 bp, Homo sapiens
gaggcgaataggacccaggtagaagt

SEQ ID NO: 3431 - DNA, 23 bp, Homo sapiens
ggttgctgacctcatctgtcttt

SEQ ID NO: 3432 - DNA, 23 bp, Homo sapiens
gcctgtggctttatgcctgggtc

SEQ ID NO: 3433 - DNA, 26 bp, Homo sapiens
tgttgttggacctatctgagcaaagg

SEQ ID NO: 3434 - DNA, 26 bp, Homo sapiens
ggtattgccagccacagcgtttgata

SEQ ID NO: 3435 - DNA, 23 bp, Homo sapiens
gctcagccctcactgcccaacat

SEQ ID NO: 3436 - DNA, 25 bp, Homo sapiens
actgaagtattacaggagtgatggg

SEQ ID NO: 3437 - DNA, 26 bp, Homo sapiens
tcaatcccacctgaaccctaatgaat

SEQ ID NO: 3438 - DNA, 23 bp, Homo sapiens
ggtccttgttggatgtgctgggc

SEQ ID NO: 3439 - DNA, 26 bp, Homo sapiens
ggctattggaatggctgaagtgtgaa

SEQ ID NO: 3440 - DNA, 23 bp, Homo sapiens
agagatgcccttcctgactgccc

SEQ ID NO: 3441 - DNA, 23 bp, Homo sapiens
tgtgacggtgcctgcttcccctt

SEQ ID NO: 3442 - DNA, 26 bp, Homo sapiens
cttttgaaggtcatctcaggaagggc

SEQ ID NO: 3443 - DNA, 26 bp, Homo sapiens
gctctcacatttattttatgccagtc

SEQ ID NO: 3444 - DNA, 23 bp, Homo sapiens
cgcctgtaatcccaccactttgg

SEQ ID NO: 3445 - DNA, 23 bp, Homo sapiens
cccaaacgctttccaccaggtcc

SEQ ID NO: 3446 - DNA, 23 bp, Homo sapiens
ggcaggagaatcacttgaaccta

SEQ ID NO: 3447 - DNA, 26 bp, Homo sapiens
ctcccacattctttgttcatcttcaa

SEQ ID NO: 3448 - DNA, 26 bp, Homo sapiens
cctatctggctgtgacacctgctgat

SEQ ID NO: 3449 - DNA, 26 bp, Homo sapiens
gtctgaggacccacacaaaggaactt

SEQ ID NO: 3450 - DNA, 23 bp, Homo sapiens
gttccattgttgggagagttgac

SEQ ID NO: 3451 - DNA, 23 bp, Homo sapiens
cagcaacctcttctggtctttga

SEQ ID NO: 3452 - DNA, 24 bp, Homo sapiens
atcccagcattttggaagactgag

SEQ ID NO: 3453 - DNA, 26 bp, Homo sapiens
cccactggagcataagatgaaccaat

SEQ ID NO: 3454 - DNA, 23 bp, Homo sapiens
gcctctgaagaagcactgccagg

SEQ ID NO: 3455 - DNA, 26 bp, Homo sapiens
ggttggtagtggcttctttcctggca

SEQ ID NO: 3456 - DNA, 25 bp, Homo sapiens
atggagcgaggtatggtggcattgc

SEQ ID NO: 3457 - DNA, 24 bp, Homo sapiens
tcagtgtttgcttttcccttgaat

SEQ ID NO: 3458 - DNA, 23 bp, Homo sapiens
cgcctgtaaccccagcattttgg

SEQ ID NO: 3459 - DNA, 23 bp, Homo sapiens
aaggttcttgccacattccgccc

SEQ ID NO: 3460 - DNA, 23 bp, Homo sapiens
gcataaaagagccacctgccagc

SEQ ID NO: 3461 - DNA, 23 bp, Homo sapiens
caaagtgctgaagttatgggcgt

SEQ ID NO: 3462 - DNA, 23 bp, Homo sapiens
tagggtgggcacagaagggtggt

SEQ ID NO: 3463 - DNA, 24 bp, Homo sapiens
gcagatagcaggagacccctactg

SEQ ID NO: 3464 - DNA, 25 bp, Homo sapiens
taaaagccatccctgcctccttggg

SEQ ID NO: 3465 - DNA, 25 bp, Homo sapiens
gatttctcagtttacatagttcaaa

SEQ ID NO: 3466 - DNA, 23 bp, Homo sapiens
cgcctgtaatcccaccactttgg

SEQ ID NO: 3467 - DNA, 26 bp, Homo sapiens
atgcccagtcataggtgataagatta

SEQ ID NO: 3468 - DNA, 24 bp, Homo sapiens
caggaatcatttgacacaatcccc

SEQ ID NO: 3469 - DNA, 23 bp, Homo sapiens
ttcttgccacattccgccccagc

SEQ ID NO: 3470 - DNA, 23 bp, Homo sapiens
cccttctaatgtccataggctac

SEQ ID NO: 3471 - DNA, 26 bp, Homo sapiens
ccgagggatagggattctgttttgtt

SEQ ID NO: 3472 - DNA, 26 bp, Homo sapiens
tgttgttggacctatctgagcaaagg

SEQ ID NO: 3473 - DNA, 26 bp, Homo sapiens
cagtcttggctggtgatgattcctga

SEQ ID NO: 3474 - DNA, 26 bp, Homo sapiens
gcctaagtccagtagtatggtggctg

SEQ ID NO: 3475 - DNA, 26 bp, Homo sapiens
ggagagatttgtgccagactacagtg

SEQ ID NO: 3476 - DNA, 26 bp, Homo sapiens
tgttgttggacctatctgagcaaagg

SEQ ID NO: 3477 - DNA, 23 bp, Homo sapiens
gttccagttcaggagcctctctc

SEQ ID NO: 3478 - DNA, 23 bp, Homo sapiens
cataacctcccttctccccattt

SEQ ID NO: 3479 - DNA, 26 bp, Homo sapiens
gcagcattcctgtatgtggtttgact

SEQ ID NO: 3480 - DNA, 24 bp, Homo sapiens
aaggaagaagagtcaccataggac

SEQ ID NO: 3481 - DNA, 26 bp, Homo sapiens
ggtgtgtgtttatgtgtgactatttg

SEQ ID NO: 3482 - DNA, 23 bp, Homo sapiens
gaactggaggagggtggataggg

SEQ ID NO: 3483 - DNA, 26 bp, Homo sapiens
ggttctaaagttccatttggttctcc

SEQ ID NO: 3484 - DNA, 26 bp, Homo sapiens
gacacctggcagcagtcatttacagt

SEQ ID NO: 3485 - DNA, 26 bp, Homo sapiens
ttcttcaatggctcctgatgcttagc

SEQ ID NO: 3486 - DNA, 24 bp, Homo sapiens
tcctttcctgagagagtagggata

SEQ ID NO: 3487 - DNA, 26 bp, Homo sapiens
cttttacttcagggaccccaggtgtc

SEQ ID NO: 3488 - DNA, 26 bp, Homo sapiens
ttattctacccttcctgccctgccct

SEQ ID NO: 3489 - DNA, 23 bp, Homo sapiens
gttcggcttgatggcagagactc

SEQ ID NO: 3490 - DNA, 23 bp, Homo sapiens
agactgtgattcccagggcagga

SEQ ID NO: 3491 - DNA, 23 bp, Homo sapiens
ctcaaagccatctcctggtaggg

SEQ ID NO: 3492 - DNA, 26 bp, Homo sapiens
ctgggactacttaggtatgagccacc

SEQ ID NO: 3493 - DNA, 23 bp, Homo sapiens
gggaaagagcaacaggagacacc

SEQ ID NO: 3494 - DNA, 24 bp, Homo sapiens
cataaactcctaccaactaagaat

SEQ ID NO: 3495 - DNA, 26 bp, Homo sapiens
tttctacagatacgcacccacacaga

SEQ ID NO: 3496 - DNA, 24 bp, Homo sapiens
tcaggcttgggctctgtaatggag

SEQ ID NO: 3497 - DNA, 23 bp, Homo sapiens
tactggaaaggatgtcttctggg

SEQ ID NO: 3498 - DNA, 24 bp, Homo sapiens
gactgttttcagagacaatggaat

SEQ ID NO: 3499 - DNA, 23 bp, Homo sapiens
tccctgtaatcccagcattttgg

SEQ ID NO: 3500 - DNA, 23 bp, Homo sapiens
ctccacttctaccaccacgagta

SEQ ID NO: 3501 - DNA, 23 bp, Homo sapiens
aagagacagacaggctgggcgtg

SEQ ID NO: 3502 - DNA, 26 bp, Homo sapiens
gcattcggttatctgtttgcttactt

SEQ ID NO: 3503 - DNA, 23 bp, Homo sapiens
tggaaactgggagaggagacagc

SEQ ID NO: 3504 - DNA, 26 bp, Homo sapiens
tcatcgtcagacccaagatacttttg

SEQ ID NO: 3505 - DNA, 26 bp, Homo sapiens
gtgggaaaggatggagagttggatga

SEQ ID NO: 3506 - DNA, 26 bp, Homo sapiens
caggttgtgtgtgggagtagaaagtc

SEQ ID NO: 3507 - DNA, 24 bp, Homo sapiens
tactaagaggtagagtgagacagc

SEQ ID NO: 3508 - DNA, 24 bp, Homo sapiens
cctttatcttccctaccccatcat

SEQ ID NO: 3509 - DNA, 23 bp, Homo sapiens
cctgtctcagcctcccaagtagc

SEQ ID NO: 3510 - DNA, 23 bp, Homo sapiens
cggcttcaggcatacacacacac

SEQ ID NO: 3511 - DNA, 23 bp, Homo sapiens
ccttctgggacactgcccctgtg

SEQ ID NO: 3512 - DNA, 23 bp, Homo sapiens
agaggcaccagatgcggaggaag

SEQ ID NO: 3513 - DNA, 26 bp, Homo sapiens
gtgtatgtaactgaacaaagtgagtc

SEQ ID NO: 3514 - DNA, 24 bp, Homo sapiens
gactacatttctcattttactgaa

SEQ ID NO: 3515 - DNA, 23 bp, Homo sapiens
ggactacaggcgtgagccaccac

SEQ ID NO: 3516 - DNA, 26 bp, Homo sapiens
gacagagacttgtagattggttcaaa

SEQ ID NO: 3517 - DNA, 26 bp, Homo sapiens
gacccattctatcccctctactctgc

SEQ ID NO: 3518 - DNA, 24 bp, Homo sapiens
aatgtaaatgttctaatggacaca

SEQ ID NO: 3519 - DNA, 23 bp, Homo sapiens
ggatgagcctgtggtcccttagg

SEQ ID NO: 3520 - DNA, 23 bp, Homo sapiens
taatgacctccagccccatccat

SEQ ID NO: 3521 - DNA, 26 bp, Homo sapiens
gcgagtgtgatgaggtttgctttatg

SEQ ID NO: 3522 - DNA, 26 bp, Homo sapiens
ccacttgctacctgtgtgatactgac

SEQ ID NO: 3523 - DNA, 26 bp, Homo sapiens
ctttcactaatgtgtggtctgtggca

SEQ ID NO: 3524 - DNA, 26 bp, Homo sapiens
ttccctgccttcctactcttcttggg

SEQ ID NO: 3525 - DNA, 26 bp, Homo sapiens
ggagcccttggtcttgtaatctgagc

SEQ ID NO: 3526 - DNA, 26 bp, Homo sapiens
ctggagtgagaaggaagggcagtttc

SEQ ID NO: 3527 - DNA, 23 bp, Homo sapiens
ggaatcccctcctgtgtgccagc

SEQ ID NO: 3528 - DNA, 23 bp, Homo sapiens
cgagtaggatgagaagggcaccc

SEQ ID NO: 3529 - DNA, 26 bp, Homo sapiens
gtgctgtttgccaactggtatgggac

SEQ ID NO: 3530 - DNA, 24 bp, Homo sapiens
atcagtgttttctcctctcaaata

SEQ ID NO: 3531 - DNA, 26 bp, Homo sapiens
tttccctactttcttgctgtgtgacc

SEQ ID NO: 3532 - DNA, 26 bp, Homo sapiens
ggacataagcccaaacaggaacactg

SEQ ID NO: 3533 - DNA, 26 bp, Homo sapiens
tttgaggtgagtctggctaaacacag

SEQ ID NO: 3534 - DNA, 26 bp, Homo sapiens
ctatttggattgttgaaagccttggt

SEQ ID NO: 3535 - DNA, 23 bp, Homo sapiens
gccttgccagaaagcacacagag

SEQ ID NO: 3536 - DNA, 23 bp, Homo sapiens
tacggaagatggaagtgaggtgc

SEQ ID NO: 3537 - DNA, 23 bp, Homo sapiens
gacaagagtcctatctgggctcc

SEQ ID NO: 3538 - DNA, 23 bp, Homo sapiens
agagcagcaaatccgtgactggg

SEQ ID NO: 3539 - DNA, 23 bp, Homo sapiens
agagcagcaaatccgtgactggg

SEQ ID NO: 3540 - DNA, 23 bp, Homo sapiens
agagcagcaaatccgtgactggg

SEQ ID NO: 3541 - DNA, 26 bp, Homo sapiens
gtgtatgtaactgaacaaagtgagtc

SEQ ID NO: 3542 - DNA, 23 bp, Homo sapiens
cctgtgctctgctgtagtggaga

SEQ ID NO: 3543 - DNA, 26 bp, Homo sapiens
gaaatgagtagttgtgacagaggttg

SEQ ID NO: 3544 - DNA, 26 bp, Homo sapiens
ctaatcaatctcacgctgctacataa

SEQ ID NO: 3545 - DNA, 26 bp, Homo sapiens
atgccttttctgatgttctgctgata

SEQ ID NO: 3546 - DNA, 24 bp, Homo sapiens
agaagtgaaagagcaatgaaaatg

SEQ ID NO: 3547 - DNA, 23 bp, Homo sapiens
cgtgcgacaaggactgggacaaa

SEQ ID NO: 3548 - DNA, 26 bp, Homo sapiens
tagggcttgaggctttgggtggaata

SEQ ID NO: 3549 - DNA, 26 bp, Homo sapiens
cccacccttgtttgatttcccctcat

SEQ ID NO: 3550 - DNA, 26 bp, Homo sapiens
gtagactgagtaacttgtaaagcctc

SEQ ID NO: 3551 - DNA, 23 bp, Homo sapiens
ggactacaggcgtgagccaccac

SEQ ID NO: 3552 - DNA, 24 bp, Homo sapiens
atcatcagaggattactcagaggg

SEQ ID NO: 3553 - DNA, 26 bp, Homo sapiens
gtctcttcactgtccaggtaaccctc

SEQ ID NO: 3554 - DNA, 26 bp, Homo sapiens
gctgaagacttggtcaaacctatggc

SEQ ID NO: 3555 - DNA, 23 bp, Homo sapiens
cctccccagtcaggatggttaga

SEQ ID NO: 3556 - DNA, 25 bp, Homo sapiens
aaggcacccaggttggaaaagaaaa

SEQ ID NO: 3557 - DNA, 23 bp, Homo sapiens
gctgccccagaggtcttcacatc

SEQ ID NO: 3558 - DNA, 23 bp, Homo sapiens
ggcgtgatttacattcccagccg

SEQ ID NO: 3559 - DNA, 26 bp, Homo sapiens
ccaccatccctcaccctacacatctt

SEQ ID NO: 3560 - DNA, 23 bp, Homo sapiens
gcatctgaaagaggaggaggagg

SEQ ID NO: 3561 - DNA, 26 bp, Homo sapiens
ggaaactgaaaccgtaacaaggaaca

SEQ ID NO: 3562 - DNA, 26 bp, Homo sapiens
gtctggcacaagaaagggctcaatga

SEQ ID NO: 3563 - DNA, 23 bp, Homo sapiens
tgagttgctgggaccacaggcat

SEQ ID NO: 3564 - DNA, 23 bp, Homo sapiens
aaggattgcttgagcccaggaat

SEQ ID NO: 3565 - DNA, 23 bp, Homo sapiens
gacacctccaggctacacagaca

SEQ ID NO: 3566 - DNA, 23 bp, Homo sapiens
tactggaaaggatgtcttctggg

SEQ ID NO: 3567 - DNA, 23 bp, Homo sapiens
ggtgggctgagtaaacgggacag

SEQ ID NO: 3568 - DNA, 26 bp, Homo sapiens
caaccctgccacggaaaacaaaacaa

SEQ ID NO: 3569 - DNA, 26 bp, Homo sapiens
ctcactaatgacatcccacatcgcag

SEQ ID NO: 3570 - DNA, 23 bp, Homo sapiens
cacctgtaatcccagcactttgg

SEQ ID NO: 3571 - DNA, 23 bp, Homo sapiens
ggcaacagaatgagaccctatct

SEQ ID NO: 3572 - DNA, 23 bp, Homo sapiens
ggctcacacctgtaatcccagcg

SEQ ID NO: 3573 - DNA, 26 bp, Homo sapiens
tccacatcccaccttgacctcttcct

SEQ ID NO: 3574 - DNA, 23 bp, Homo sapiens
gtcccacctcccaatactatggc

SEQ ID NO: 3575 - DNA, 26 bp, Homo sapiens
cctctcagccttcatctttgtatttg

SEQ ID NO: 3576 - DNA, 26 bp, Homo sapiens
gcccaatgacagagcatcaaaacaca

SEQ ID NO: 3577 - DNA, 24 bp, Homo sapiens
gagagaaactaaagtccaggagac

SEQ ID NO: 3578 - DNA, 26 bp, Homo sapiens
cagcactttccacttctaaaatcaga

SEQ ID NO: 3579 - DNA, 23 bp, Homo sapiens
cggagtcttgctctgttgcgagg

SEQ ID NO: 3580 - DNA, 23 bp, Homo sapiens
cccaaactccaaaggcagcgtgc

SEQ ID NO: 3581 - DNA, 24 bp, Homo sapiens
gagagaagtgaggaaaagtggcta

SEQ ID NO: 3582 - DNA, 23 bp, Homo sapiens
gacatcctgctccccatagtgga

SEQ ID NO: 3583 - DNA, 23 bp, Homo sapiens
ggctgggagaggttagagatgac

SEQ ID NO: 3584 - DNA, 26 bp, Homo sapiens
ccagttatcgttttgtaggtagacca

SEQ ID NO: 3585 - DNA, 25 bp, Homo sapiens
tggattgttctttagatttcagata

SEQ ID NO: 3586 - DNA, 24 bp, Homo sapiens
gtcacttgtgctaaatgccacttc

SEQ ID NO: 3587 - DNA, 24 bp, Homo sapiens
gaagcagaagaaggagcaagaaag

SEQ ID NO: 3588 - DNA, 23 bp, Homo sapiens
ctccacttctaccaccacgagta

SEQ ID NO: 3589 - DNA, 23 bp, Homo sapiens
gctatggcaacaacctgtggagg

SEQ ID NO: 3590 - DNA, 24 bp, Homo sapiens
ccatcatcggttgaatccacagat

SEQ ID NO: 3591 - DNA, 26 bp, Homo sapiens
gaggacacattgggcaggaaacatcc

SEQ ID NO: 3592 - DNA, 26 bp, Homo sapiens
ccatccaccccacttcatcctttgtg

SEQ ID NO: 3593 - DNA, 26 bp, Homo sapiens
cccttcagtggaaccttacccaacaa

SEQ ID NO: 3594 - DNA, 26 bp, Homo sapiens
gtggtgtggttcaaagagcactgtaa

SEQ ID NO: 3595 - DNA, 26 bp, Homo sapiens
aacaacccgccactggaaccctttta

SEQ ID NO: 3596 - DNA, 26 bp, Homo sapiens
gtcttggtgttccttacggtgcctgt

SEQ ID NO: 3597 - DNA, 23 bp, Homo sapiens
ggactacaggcgtgagccaccac

SEQ ID NO: 3598 - DNA, 23 bp, Homo sapiens
cgcccagcctaatgtgagatttt

SEQ ID NO: 3599 - DNA, 26 bp, Homo sapiens
ctgccctcttcctttccctcctgtat

SEQ ID NO: 3600 - DNA, 24 bp, Homo sapiens
ttttattttcatttggaagactgc

SEQ ID NO: 3601 - DNA, 26 bp, Homo sapiens
aaggacaatagggatgtaaacacaca

SEQ ID NO: 3602 - DNA, 60 bp, Homo sapiens; identical to SEQ ID NO: 1135

SEQ ID NO: 3603 - DNA, 60 bp, Homo sapiens; identical to SEQ ID NO: 1118

SEQ ID NO: 3604 - DNA, 60 bp, Homo sapiens; identical to SEQ ID NO: 1406

SEQ ID NO: 3605 - DNA, 60 bp, Homo sapiens; identical to SEQ ID NO: 1143

SEQ ID NO: 3606 - DNA, 60 bp, Homo sapiens; identical to SEQ ID NO: 1100

SEQ ID NO: 3607 - DNA, 60 bp, Homo sapiens; identical to SEQ ID NO: 1147

SEQ ID NO: 3608 - DNA, 60 bp, Homo sapiens; identical to SEQ ID NO: 1138

SEQ ID NO: 3609 - DNA, 60 bp, Homo sapiens; identical to SEQ ID NO: 1351

SEQ ID NO: 3610 - DNA, 60 bp, Homo sapiens; identical to SEQ ID NO: 1144

SEQ ID NO: 3611 - DNA, 60 bp, Homo sapiens; identical to SEQ ID NO: 1409

SEQ ID NO: 3612 - DNA, 60 bp, Homo sapiens; identical to SEQ ID NO: 1336

SEQ ID NO: 3613 - DNA, 60 bp, Homo sapiens; identical to SEQ ID NO: 1375

SEQ ID NO: 3614 - DNA, 60 bp, Homo sapiens
ttggaaaaggtaaattgtgttttgtaaatcgagtgatttttagttcttccagacataaaa

SEQ ID NO: 3615 - DNA, 60 bp, Homo sapiens
taaaactgggatatttgtttttccttgatcgaacactccagacatactaaattagaaatt

SEQ ID NO: 3616 - DNA, 60 bp, Homo sapiens
gattacatagaaatagccaatggatttatcgataaacagttcctatcatcagctatggag

SEQ ID NO: 3617 - DNA, 60 bp, Homo sapiens; identical to SEQ ID NO: 2286

SEQ ID NO: 3618 - DNA, 60 bp, Homo sapiens
taaagttttggaagaaaatattggaaactcgatatttcttaaagcatgtctaccttccat

SEQ ID NO: 3619 - DNA, 60 bp, Homo sapiens
ctcctttgatgtagtcatcaatgccttttcgaaattccaaaaaactgcatttttagaacc

SEQ ID NO: 3620 - DNA, 60 bp, Homo sapiens
ttttgtcctagttgtagcttttataatttcgaaagattcttccaggcagagttgcagatt

SEQ ID NO: 3621 - DNA, 60 bp, Homo sapiens
gttaaaattatttaaaatattacacttatcgacagaaaaatcaaacttctggtcatggct

SEQ ID NO: 3622 - DNA, 60 bp, Homo sapiens
atgtgtttttcaaattttatcaaaaagctcgagtcttttgtttttgtcaatagtattatt

SEQ ID NO: 3623 - DNA, 60 bp, Homo sapiens
aacccctctgagcaaatctcccactgcctcgacttaactggaggcttggtcctttccgag

SEQ ID NO: 3624 - DNA, 60 bp, Homo sapiens
aacccctctgagcaaatctcccactgcctcgacttcccggaaattctgacctgtagcatt

SEQ ID NO: 3625 - DNA, 60 bp, Homo sapiens
tttaaaatagtgaatttaaattcatccatcgacatttcaaaaaaaaaccagatctgtctt

SEQ ID NO: 3626 - DNA, 60 bp, Homo sapiens
aaatcccttcaatggctttttttttttttcgaagcttactctgagtaccacctccttcag

SEQ ID NO: 3627 - DNA, 60 bp, Homo sapiens
ttgatgagagttgattcataagttaatatcgaagttagtggttagacaaaattttgctct

SEQ ID NO: 3628 - DNA, 60 bp, Homo sapiens
aaagtcatacaactactatgtaagatattcgaggtgggtcaatttgtcaaattaaaagaa

SEQ ID NO: 3629 - DNA, 60 bp, Homo sapiens
tgtcaaattcaccttttcagtagtaacttcgacccaataaaatatctctaggatgagata

SEQ ID NO: 3630 - DNA, 60 bp, Homo sapiens
tattctgttgaattgttttggttttctttcgaaagactccaagacaggaacaagcgtggc

SEQ ID NO: 3631 - DNA, 60 bp, Homo sapiens
attcttagtaaatttgcataatgtggcatcgataaaattcttctccgccttactcactct

SEQ ID NO: 3632 - DNA, 60 bp, Homo sapiens
aaccggttttgtcacaaacattgaaaaatcgacgtttattttatacaaacaataaagaca

SEQ ID NO: 3633 - DNA, 60 bp, Homo sapiens
aacccctctgagcaaatctcccactgcctcgaacctcatgtttaggtggtggaagcgagt

SEQ ID NO: 3634 - DNA, 60 bp, Homo sapiens
tttaaaatagtgaatttaaattcatccatcgagaaataaggtacaaaaagtagaagagac

SEQ ID NO: 3635 - DNA, 60 bp, Homo sapiens
aattacaaataaaagccaattcaatttttcgattgaaagaggatgacgattgtttccctc

SEQ ID NO: 3636 - DNA, 60 bp, Homo sapiens
ttatttaatcattaatttcctcctctcgtcgaaggtacaaattgttttcaaatggaaaga

SEQ ID NO: 3637 - DNA, 60 bp, Homo sapiens
ctgcctttagggataacattttactggttcgacaagttaatcttcctaacaagaatcact

SEQ ID NO: 3638 - DNA, 60 bp, Homo sapiens
atatttaatgtcctatatctgcagatattcgacacgtggtgacatgtgtaagaagtcctg

SEQ ID NO: 3639 - DNA, 60 bp, Homo sapiens
aacccctctgagcaaatctcccactgcctcgaggttaattttttcccctcttaataagcg

SEQ ID NO: 3640 - DNA, 60 bp, Homo sapiens
actagttaacatttcgtctaaaattttatcgaggaaggctaatgttttttgatctctaat

SEQ ID NO: 3641 - DNA, 60 bp, Homo sapiens
tcttcatagctaaatgtattactaagcttcgaaaaaattatttaatttgtgctaacgtta

SEQ ID NO: 3642 - DNA, 60 bp, Homo sapiens
ctatagaaattaaaataatattaagagttcgagtgattctttaaaaattgaacatttcca

SEQ ID NO: 3643 - DNA, 60 bp, Homo sapiens
aacccctctgagcaaatctcccactgcctcgatttcctcgcctgtgaaatgggaaatcag

SEQ ID NO: 3644 - DNA, 60 bp, Homo sapiens
tatttagctatagttttttctcactttatcgagtgatagtccaattagtttatttatagg

SEQ ID NO: 3645 - DNA, 60 bp, Homo sapiens
ttggaattcatagcaattgctgctgcattcgaaatcggcagagtttgttcattcaattag

SEQ ID NO: 3646 - DNA, 60 bp, Homo sapiens
tgtgcatcttttttctttttttcttttttcgagtgagttgagttaaaataattccgtagg

SEQ ID NO: 3647 - DNA, 60 bp, Homo sapiens
tctcttcagtcattatttaaactacttatcgatatctgtttacttaaccacaaagataac

SEQ ID NO: 3648 - DNA, 60 bp, Homo sapiens
aaaactcaggctttgccactgagagacctcgaggcctccacccctgccccggagagaaag

SEQ ID NO: 3649 - DNA, 60 bp, Homo sapiens
tgcttttgaacggcttttaaaataattctcgagagctctcatatgattatttgggctcaa

SEQ ID NO: 3650 - DNA, 60 bp, Homo sapiens
tcataaaataataattaacaaacatacatcgatgccaagtctttcttctggtttctttat

SEQ ID NO: 3651 - DNA, 60 bp, Homo sapiens
agacttcattttcaagcttcaaatattttcgatttttaaagatttcccccaagtgactga

SEQ ID NO: 3652 - DNA, 60 bp, Homo sapiens
atgaaatataagtttaaaagattggaaatcgacaatgggttattcaggaatttaaacttt

SEQ ID NO: 3653 - DNA, 23 bp, Homo sapiens
gcgttggagaagacctcagccat

SEQ ID NO: 3654 - DNA, 26 bp, Homo sapiens
cagtggtaatctatgggtggtaggaa

SEQ ID NO: 3655 - DNA, 24 bp, Homo sapiens
agaatgggtcttactttgaaaata

SEQ ID NO: 3656 - DNA, 24 bp, Homo sapiens
tcacccagtttctgctgtcaatgc

SEQ ID NO: 3657 - DNA, 24 bp, Homo sapiens
acaaaatagaaccctggtcccacc

SEQ ID NO: 3658 - DNA, 26 bp, Homo sapiens
gcatagggtagttgctccttgagttt

SEQ ID NO: 3659 - DNA, 24 bp, Homo sapiens
gtgttcattacctgatttgattta

SEQ ID NO: 3660 - DNA, 24 bp, Homo sapiens
tggcagtcatcaaaatcgcttcta

SEQ ID NO: 3661 - DNA, 24 bp, Homo sapiens
aatgaactatcaggctatgtaaaa

SEQ ID NO: 3662 - DNA, 26 bp, Homo sapiens
gaaaaccagtcaatcctcaagtgtgc

SEQ ID NO: 3663 - DNA, 24 bp, Homo sapiens
aggcttccttgttgtgttcataat

SEQ ID NO: 3664 - DNA, 23 bp, Homo sapiens
agatgtgtgtgggctctcgggct

SEQ ID NO: 3665 - DNA, 28 bp, Homo sapiens
gagatgggttgctggctggagtcttctg

SEQ ID NO: 3666 - DNA, 28 bp, Homo sapiens
gggagcatcactatcttcttcagttggg

SEQ ID NO: 3667 - DNA, 26 bp, Homo sapiens
gccacagccaccatcagaatgaagtt

SEQ ID NO: 3668 - DNA, 26 bp, Homo sapiens
cttacagccttccaaaataactccag

SEQ ID NO: 3669 - DNA, 26 bp, Homo sapiens
tcttacatcacaccacatccccaaat

SEQ ID NO: 3670 - DNA, 26 bp, Homo sapiens
caccaatccctacattttcatcctca

SEQ ID NO: 3671 - DNA, 23 bp, Homo sapiens
tctgttgcgggtctcttgagggc

SEQ ID NO: 3672 - DNA, 26 bp, Homo sapiens
cctggaacttgggcaaactaaactcc

SEQ ID NO: 3673 - DNA, 26 bp, Homo sapiens
gagcaggaaagtcaaaggaaaggagg

SEQ ID NO: 3674 - DNA, 23 bp, Homo sapiens
gtgcgggattcagaccttcagca

SEQ ID NO: 3675 - DNA, 23 bp, Homo sapiens
ggtgcgggattcagaccttcagc

SEQ ID NO: 3676 - DNA, 28 bp, Homo sapiens
gctatctatcactcagggctttccaggg

SEQ ID NO: 3677 - DNA, 26 bp, Homo sapiens
tccatccttctcacagcagccaagag

SEQ ID NO: 3678 - DNA, 25 bp, Homo sapiens
tatttttcctgattgtaaagtaaat

SEQ ID NO: 3679 - DNA, 27 bp, Homo sapiens
tgaaaaccagtcaatcctcaagtgtgc

SEQ ID NO: 3680 - DNA, 27 bp, Homo sapiens
ggggaaatgttgcaattaactaatttt

SEQ ID NO: 3681 - DNA, 26 bp, Homo sapiens
tggtattgctccacttctggcactgc

SEQ ID NO: 3682 - DNA, 28 bp, Homo sapiens
ctcttctatggaggtttcttggagggac

SEQ ID NO: 3683 - DNA, 26 bp, Homo sapiens
ccaccgatttattgccctgtaggaca

SEQ ID NO: 3684 - DNA, 23 bp, Homo sapiens
ggtgcgggattcagaccttcagc

SEQ ID NO: 3685 - DNA, 28 bp, Homo sapiens
gctatctatcactcagggctttccaggg

SEQ ID NO: 3686 - DNA, 23 bp, Homo sapiens
gagcccatcagagcacccattct

SEQ ID NO: 3687 - DNA, 23 bp, Homo sapiens
gcatctccgccgcctacttgggc

SEQ ID NO: 3688 - DNA, 28 bp, Homo sapiens
ggaatccagccaagggaggcattaggac

SEQ ID NO: 3689 - DNA, 26 bp, Homo sapiens
ccaaaccaaggaggtgacaatggagg

SEQ ID NO: 3690 - DNA, 23 bp, Homo sapiens
gtgcgggattcagaccttcagca

SEQ ID NO: 3691 - DNA, 26 bp, Homo sapiens
tcactggcattcatagatgtggtcac

SEQ ID NO: 3692 - DNA, 26 bp, Homo sapiens
ctcccctaccttttcctgccttcttc

SEQ ID NO: 3693 - DNA, 26 bp, Homo sapiens
gacatttggtgacccattactcaaca

SEQ ID NO: 3694 - DNA, 23 bp, Homo sapiens
ggtgcgggattcagaccttcagc

SEQ ID NO: 3695 - DNA, 28 bp, Homo sapiens
cctggaatagccttgcttgttttgtggc

SEQ ID NO: 3696 - DNA, 28 bp, Homo sapiens
gttgagggtgaaggctaacagttttgag

SEQ ID NO: 3697 - DNA, 26 bp, Homo sapiens
cccagttatttctacagtttggaagc

SEQ ID NO: 3698 - DNA, 26 bp, Homo sapiens
ccgctgtgtttgggtatgtaggattc

SEQ ID NO: 3699 - DNA, 23 bp, Homo sapiens
ggaggaagcccagccacttgagt

SEQ ID NO: 3700 - DNA, 26 bp, Homo sapiens
gaagaggaggtattccactgtctgaa

SEQ ID NO: 3701 - DNA, 26 bp, Homo sapiens
gctctgcctttcatttacacacagga

SEQ ID NO: 3702 - DNA, 26 bp, Homo sapiens
gggaagaggctacattgttatggata

SEQ ID NO: 3703 - DNA, 30 bp, Homo sapiens
agagacagggtttcaccatattggccagga

SEQ ID NO: 3704 - DNA, 23 bp, Homo sapiens
aaacgggtctccacggcaccaag

SEQ ID NO: 3705 - DNA, 26 bp, Homo sapiens
ggtgactgacagccaaatccaatggg

SEQ ID NO: 3706 - DNA, 24 bp, Homo sapiens
cttttattttagatacagtggtgt

SEQ ID NO: 3707 - DNA, 24 bp, Homo sapiens
atcagtgttttctcctctcaaata

SEQ ID NO: 3708 - DNA, 25 bp, Homo sapiens
ggaaaatctaaaagtaatggacaaa

SEQ ID NO: 3709 - DNA, 26 bp, Homo sapiens
acacggtccctgactcaagatggttg

SEQ ID NO: 3710 - DNA, 24 bp, Homo sapiens
tcttatttcccaaggctcaaaagc

SEQ ID NO: 3711 - DNA, 24 bp, Homo sapiens
cagacaaagcaaaagatttcctat

SEQ ID NO: 3712 - DNA, 24 bp, Homo sapiens
tacagtatttgagtcacaggctgc

SEQ ID NO: 3713 - DNA, 26 bp, Homo sapiens
ctcaagtcctcatctgtagagtctgg

SEQ ID NO: 3714 - DNA, 24 bp, Homo sapiens
ttcttccctcagccatccatttgg

SEQ ID NO: 3715 - DNA, 23 bp, Homo sapiens
gtcaccgtccccagcaagaaaga

SEQ ID NO: 3716 - DNA, 28 bp, Homo sapiens
ctgcccttgtatttctgactccgtaacc

SEQ ID NO: 3717 - DNA, 28 bp, Homo sapiens
gcagccattccacttgaccctctgtatc

SEQ ID NO: 3718 - DNA, 26 bp, Homo sapiens
tcatctcagttgctttctgctggagc

SEQ ID NO: 3719 - DNA, 26 bp, Homo sapiens
atggcattccctgatttccctggatg

SEQ ID NO: 3720 - DNA, 26 bp, Homo sapiens
tggcactctcaccaagacaacctcag

SEQ ID NO: 3721 - DNA, 26 bp, Homo sapiens
aagaaaggagcaagccaaggatgcct

SEQ ID NO: 3722 - DNA, 23 bp, Homo sapiens
gactgggcacacaggaagcacta

SEQ ID NO: 3723 - DNA, 26 bp, Homo sapiens
gaactccaaacacatacccctgacag

SEQ ID NO: 3724 - DNA, 26 bp, Homo sapiens
gccaaagaaatggaatgctgatgaat

SEQ ID NO: 3725 - DNA, 23 bp, Homo sapiens
actacctggaaagggagaccccg

SEQ ID NO: 3726 - DNA, 23 bp, Homo sapiens
gcaggcacaatccttcccaatgc

SEQ ID NO: 3727 - DNA, 27 bp, Homo sapiens
gccttggctacggactgtcaactcagc

SEQ ID NO: 3728 - DNA, 26 bp, Homo sapiens
gggattgagcagacagattagtgaaa

SEQ ID NO: 3729 - DNA, 22 bp, Homo sapiens
gatttcccaactcagttaaaaa

SEQ ID NO: 3730 - DNA, 28 bp, Homo sapiens
aaccagagccccaaataaggatggaagc

SEQ ID NO: 3731 - DNA, 24 bp, Homo sapiens
ttaactattggttataagaataaa

SEQ ID NO: 3732 - DNA, 26 bp, Homo sapiens
aacagtcttcttcctgcctcactact

SEQ ID NO: 3733 - DNA, 26 bp, Homo sapiens
cagtgggcagaagggcgggttacagc

SEQ ID NO: 3734 - DNA, 26 bp, Homo sapiens
gattgatgaagtggaagtggcaggca

SEQ ID NO: 3735 - DNA, 23 bp, Homo sapiens
caagtgcttcctgaggtgactgc

SEQ ID NO: 3736 - DNA, 28 bp, Homo sapiens
cccatcctaaagtgactgaacggcagca

SEQ ID NO: 3737 - DNA, 23 bp, Homo sapiens
ctgacctctcctggcttcctgct

SEQ ID NO: 3738 - DNA, 28 bp, Homo sapiens
tctcacccctccccaggatggctccact

SEQ ID NO: 3739 - DNA, 26 bp, Homo sapiens
gagagagcaacagagggcagggtccc

SEQ ID NO: 3740 - DNA, 26 bp, Homo sapiens
ggactcctcctctatcaagccttatt

SEQ ID NO: 3741 - DNA, 23 bp, Homo sapiens
cgccacgcctgactaccatccaa

SEQ ID NO: 3742 - DNA, 26 bp, Homo sapiens
gacatcacggaaaaggtagcccaagg

SEQ ID NO: 3743 - DNA, 26 bp, Homo sapiens
tcagaaccaggcagagccaatgaaaa

SEQ ID NO: 3744 - DNA, 26 bp, Homo sapiens
gctatgaggcaaatcaaaagtaaagc

SEQ ID NO: 3745 - DNA, 23 bp, Homo sapiens
gcctcacaaaagcggcaggacat

SEQ ID NO: 3746 - DNA, 26 bp, Homo sapiens
gctttctatcctgtaagagtctatgc

SEQ ID NO: 3747 - DNA, 26 bp, Homo sapiens
gggaaaaggcaagcaccgctctcagc

SEQ ID NO: 3748 - DNA, 26 bp, Homo sapiens
cctgcttctgagacctccacagtgtt

SEQ ID NO: 3749 - DNA, 26 bp, Homo sapiens
ggttgagtgacaaatgctgtgctctc

SEQ ID NO: 3750 - DNA, 23 bp, Homo sapiens
cagcagaaatctctccctcaggc

SEQ ID NO: 3751 - DNA, 26 bp, Homo sapiens
ggtttctggcttcagcacgagtggta

SEQ ID NO: 3752 - DNA, 26 bp, Homo sapiens
ggtctgtgatttggtggctgcgtgaa

SEQ ID NO: 3753 - DNA, 26 bp, Homo sapiens
caggctcattggcttttcccaggtct

SEQ ID NO: 3754 - DNA, 22 bp, Homo sapiens
gaagatattttgttatttccaa

SEQ ID NO: 3755 - DNA, 60 bp, Homo sapiens
gaagtttcaacttgattctttctaactttcgattttttaaaaattgtcattctgactgga

SEQ ID NO: 3756 - DNA, 60 bp, Homo sapiens; identical to SEQ ID NO: 3639

SEQ ID NO: 3757 - DNA, 60 bp, Homo sapiens
atttaattcacacagtaggattataaggtcgaccgaaatgtgtattcctcttgtgaagga

SEQ ID NO: 3758 - DNA, 60 bp, Homo sapiens
tccttccactttcagttccccatacacatcgaaaaaaatatcaaggtgaaaattcaagtt

SEQ ID NO: 3759 - DNA, 60 bp, Homo sapiens
catctctttactattaattctttcctgttcgatcactctatctatctatcatctctcacc

SEQ ID NO: 3760 - DNA, 60 bp, Homo sapiens
ctgacacttgaaccataatttttttcattcgaaagggatataaaaaattccaagtattaa

SEQ ID NO: 3761 - DNA, 60 bp, Homo sapiens
cctgggtggaattcacccaggaatacaatcgatttcctcatctataaaaatgaagctgac

SEQ ID NO: 3762 - DNA, 60 bp, Homo sapiens
tacaacacataaacattagcaagttgaatcgactttgctctcaggtagtcccattatgtg

SEQ ID NO: 3763 - DNA, 60 bp, Homo sapiens
caacatccatggaagttgctcagaagaatcgaaaaaaaaataaaaaaataaaaaaataaa

SEQ ID NO: 3764 - DNA, 60 bp, Homo sapiens
tgaagctttagtttagcgactaaagtcatcgatttttttcacatcaacgttacaccaaaa

SEQ ID NO: 3765 - DNA, 60 bp, Homo sapiens
ccccactctgccctcaattgtggttcattcgaatctctctagtaataaaaacatcactgt

SEQ ID NO: 3766 - DNA, 60 bp, Homo sapiens
tctgcataaatgactcaatacaagtttttcgaatgacattcatatgggcaaaaattatgc

SEQ ID NO: 3767 - DNA, 60 bp, Homo sapiens
tgaaaacaaagttgatatctcactcacttcgaggtgtgagagggatttgctattactgtc

SEQ ID NO: 3768 - DNA, 60 bp, Homo sapiens
ctactgagtcatattattcgcctttttttcgaatattgccttctcctcaaccaccactgg

SEQ ID NO: 3769 - DNA, 60 bp, Homo sapiens
gcttgatctttccacatcctctatcttttcgaaatgtatccacccaccccacctctaaac

SEQ ID NO: 3770 - DNA, 60 bp, Homo sapiens; identical to SEQ ID NO: 2592

SEQ ID NO: 3771 - DNA, 60 bp, Homo sapiens
taaacttttaaagaaagcaagaattgcatcgaaggcttctgtaagcatatatgtaaagct

SEQ ID NO: 3772 - DNA, 60 bp, Homo sapiens
ttaatctgtgtcaggaaatttcataatttcgaagataaggcatatgggagatgcatctct

SEQ ID NO: 3773 - DNA, 60 bp, Homo sapiens
acaaaaattaactcaaaattgatcatcatcgatgatacttaacaacatttcaaaccaggc

SEQ ID NO: 3774 - DNA, 60 bp, Homo sapiens
ctggatctgttatttatctaattatacctcgatttcaccaagtttgcaaaagattctgtg

SEQ ID NO: 3775 - DNA, 60 bp, Homo sapiens
acatagtgggccttcaatgagtgtgtattcgaattcctgcccgcccccacaccttccagc

SEQ ID NO: 3776 - DNA, 60 bp, Homo sapiens
ttttgtaacagaatttctcttgatctcctcgaagatcaggtgctgtatcttttatatctt

SEQ ID NO: 3777 - DNA, 60 bp, Homo sapiens
ttaatctactctctatctgtgtagattctcgagaactagccagtaacaaaagctgtgatt

SEQ ID NO: 3778 - DNA, 60 bp, Homo sapiens
agataatttagggatctatttgcttttttcgataacctcctgaccttgtctttcctataa

SEQ ID NO: 3779 - DNA, 60 bp, Homo sapiens
tatatacctcagcaaaaaaaaaattaaatcgatttgtagatacaggcaatgccatggaga

SEQ ID NO: 3780 - DNA, 60 bp, Homo sapiens
ccatccccacctctttcctacctgcccttcgatgcttccagtgattagaccccgggtccg

SEQ ID NO: 3781 - DNA, 60 bp, Homo sapiens
aaactttaaaacaaaatgaagttctaattcgacactattgaatatatcatagcagttaga

SEQ ID NO: 3782 - DNA, 60 bp, Homo sapiens
ccctgtctctaaaaaataataataataatcgagatgatggaagtaagaatagtggttatt

SEQ ID NO: 3783 - DNA, 60 bp, Homo sapiens
agattaaaagtatgagcagagataagactcgaaccattttgctaccaataaactgcttta

SEQ ID NO: 3784 - DNA, 60 bp, Homo sapiens
ttttagacacaaaaaattacaggtacattcgattgtgtaaacagggataattataatatt

SEQ ID NO: 3785 - DNA, 60 bp, Homo sapiens
tgtccctcttcctcatttatctacttagtcgatatgtatgtaatcaatccattcaatatc

SEQ ID NO: 3786 - DNA, 60 bp, Homo sapiens
tgagataatagaatagaacattttcatatcgatccagaggaaaaaaactaatagtggcaa

SEQ ID NO: 3787 - DNA, 60 bp, Homo sapiens
tttttaatcttataatcacgttacccattcgaaatgtacacttaaaaagggtgaattagg

SEQ ID NO: 3788 - DNA, 60 bp, Homo sapiens
ctctttcaaaacccttgcgaggattggttcgaatgtgatatttctggttcttggtataat

SEQ ID NO: 3789 - DNA, 60 bp, Homo sapiens
gggtttgttgtcaaatgttaatcgtaattcgaagatgaagaaaacacagcttcttccctc

SEQ ID NO: 3790 - DNA, 60 bp, Homo sapiens
ttgtctaataaacgtcataaagagataatcgaaaatttgaaataattactaagaacggtt

SEQ ID NO: 3791 - DNA, 60 bp, Homo sapiens
tctaaccattatgagtagatattaatcttcgaggcttatttaaagactgcctctttcaca

SEQ ID NO: 3792 - DNA, 60 bp, Homo sapiens
cccgattacttcagatttacttacagcctcgaagaaaaggtatggaaaacttcaaaattt

SEQ ID NO: 3793 - DNA, 60 bp, Homo sapiens
agttaatggtattaaggatttcagttcatcgagtttcagtgcattttttacttactttga

SEQ ID NO: 3794 - DNA, 60 bp, Homo sapiens
catgcaaatgctgaagaatacctagttttcgatttaatagtttagcatcagaagcagacc

SEQ ID NO: 3795 - DNA, 60 bp, Homo sapiens; identical to SEQ ID NO: 3623

SEQ ID NO: 3796 - DNA, 60 bp, Homo sapiens
ttaaaatattctggaagacaattatctatcgaagaaataaaaacatcaatcaaggactgg

SEQ ID NO: 3797 - DNA, 60 bp, Homo sapiens; identical to SEQ ID NO: 3643

SEQ ID NO: 3798 - DNA, 60 bp, Homo sapiens
aatataaacaaaagctttgtaattactatcgatcttgtaggaggaaggacgagatgtgtg

SEQ ID NO: 3799 - DNA, 60 bp, Homo sapiens
aaggttgttgaatgaataaaagaggtactcgataaggaaacagtagagagattaattatc

SEQ ID NO: 3800 - DNA, 60 bp, Homo sapiens
agaaaatatagcaaatatctttatgacctcgactcccctagaggaaatatattttatttc

SEQ ID NO: 3801 - DNA, 60 bp, Homo sapiens
atataatgtcagcatttcaaaacagcactcgatggaaaacaatgccacaggcaaagaacc

SEQ ID NO: 3802 - DNA, 60 bp, Homo sapiens
tggctcattcatttacttatttattcattcgatattctctccagattgtgcatcaaggtt

SEQ ID NO: 3803 - DNA, 60 bp, Homo sapiens
tgcagatgataataataactaccatttatcgagaatgttctgcatggaaaagacagagaa

SEQ ID NO: 3804 - DNA, 60 bp, Homo sapiens; identical to SEQ ID NO: 3624

SEQ ID NO: 3805 - DNA, 60 bp, Homo sapiens; identical to SEQ ID NO: 3633

SEQ ID NO: 3806 - DNA, 28 bp, Homo sapiens
gccaataaccttccagcatctccctgaa

SEQ ID NO: 3807 - DNA, 23 bp, Homo sapiens
gtgcgggattcagaccttcagca

SEQ ID NO: 3808 - DNA, 26 bp, Homo sapiens
ccaggcaccttatttgagatgtcttc

SEQ ID NO: 3809 - DNA, 26 bp, Homo sapiens
ccctggtcattcttcctgttggagac

SEQ ID NO: 3810 - DNA, 28 bp, Homo sapiens
gagcctcaccaatcccactcccttctgg

SEQ ID NO: 3811 - DNA, 26 bp, Homo sapiens
cgtaagccctgaacacgcaaatgagt

SEQ ID NO: 3812 - DNA, 26 bp, Homo sapiens
ggaaaagtggctcctctgggaacccg

SEQ ID NO: 3813 - DNA, 28 bp, Homo sapiens
ctattgtctccctttgtcttcagaaatc

SEQ ID NO: 3814 - DNA, 29 bp, Homo sapiens
ccctgagcttcctagcagctaaaacaaag

SEQ ID NO: 3815 - DNA, 23 bp, Homo sapiens
gggtggcgatggaggagagtcat

SEQ ID NO: 3816 - DNA, 26 bp, Homo sapiens
tttacagccccaccagcaacacagga

SEQ ID NO: 3817 - DNA, 23 bp, Homo sapiens
cacctcctccctcttcaatctcc

SEQ ID NO: 3818 - DNA, 26 bp, Homo sapiens
cgtctttctcccataccttcaagtct

SEQ ID NO: 3819 - DNA, 26 bp, Homo sapiens
ctcacgacaatcatctctcaaaaggc

SEQ ID NO: 3820 - DNA, 21 bp, Homo sapiens
cctcttatcagatgtatagtt

SEQ ID NO: 3821 - DNA, 23 bp, Homo sapiens
cgccacgcctgactaccatccaa

SEQ ID NO: 3822 - DNA, 26 bp, Homo sapiens
gcatactactttaccattccacacag

SEQ ID NO: 3823 - DNA, 26 bp, Homo sapiens
tcgggaggtatcaggtattcaaactg

SEQ ID NO: 3824 - DNA, 27 bp, Homo sapiens
ggtgattccgatgtggtcccagccctg

SEQ ID NO: 3825 - DNA, 26 bp, Homo sapiens
agtggttccaagacagagattgttct

SEQ ID NO: 3826 - DNA, 27 bp, Homo sapiens
gaccagcaaggaccccagtttctccac

SEQ ID NO: 3827 - DNA, 28 bp, Homo sapiens
ccaccccgacagcattatttgacagtct

SEQ ID NO: 3828 - DNA, 31 bp, Homo sapiens
tatattgttattgtaattgccattaaatggt

SEQ ID NO: 3829 - DNA, 23 bp, Homo sapiens
gcagcaggtcctcagatgatgtc

SEQ ID NO: 3830 - DNA, 26 bp, Homo sapiens
gggctggtattttctttatctggtgg

SEQ ID NO: 3831 - DNA, 23 bp, Homo sapiens
ggaggcacagtcacagtcaacgc

SEQ ID NO: 3832 - DNA, 26 bp, Homo sapiens
ctggtctaccccttcctccatctcta

SEQ ID NO: 3833 - DNA, 24 bp, Homo sapiens
gctgctgcttctctccaatgtcta

SEQ ID NO: 3834 - DNA, 23 bp, Homo sapiens
caccaccccatcaatctgctctg

SEQ ID NO: 3835 - DNA, 26 bp, Homo sapiens
gcctttcctttctggcatcatctgtt

SEQ ID NO: 3836 - DNA, 31 bp, Homo sapiens
cagattgtgaggcacccttggatcttgacct

SEQ ID NO: 3837 - DNA, 26 bp, Homo sapiens
gatgaaaatacattctctctattggg

SEQ ID NO: 3838 - DNA, 26 bp, Homo sapiens
ccacacaaatagacttgactgagttt

SEQ ID NO: 3839 - DNA, 28 bp, Homo sapiens
catctcaggaaatgaaatagccctcagc

SEQ ID NO: 3840 - DNA, 23 bp, Homo sapiens
cccacgagggcagatttcacctg

SEQ ID NO: 3841 - DNA, 28 bp, Homo sapiens
gtgaaaatgaagcagatggcaaactggg

SEQ ID NO: 3842 - DNA, 23 bp, Homo sapiens
gcaatccctccagcccttgtcaa

SEQ ID NO: 3843 - DNA, 25 bp, Homo sapiens
aaatgtgtgcctcccctgacctaca

SEQ ID NO: 3844 - DNA, 26 bp, Homo sapiens
gtaacacattcttcaaacatagtccc

SEQ ID NO: 3845 - DNA, 23 bp, Homo sapiens
ctccccattagtgcttctcctgc

SEQ ID NO: 3846 - DNA, 26 bp, Homo sapiens
gcctccactgatgttagcctgtgaca

SEQ ID NO: 3847 - DNA, 23 bp, Homo sapiens
agtggctgaggcaagaggatgtc

SEQ ID NO: 3848 - DNA, 26 bp, Homo sapiens
cccctattacattagtcaaatcacct

SEQ ID NO: 3849 - DNA, 23 bp, Homo sapiens
gccatttctcacccgctcagtag

SEQ ID NO: 3850 - DNA, 24 bp, Homo sapiens
cctcctgtccctccttcctttctc

SEQ ID NO: 3851 - DNA, 26 bp, Homo sapiens
tatgttgttgcccttgatacggtagc

SEQ ID NO: 3852 - DNA, 26 bp, Homo sapiens
cgcctgttgtcccagcactgtagata

SEQ ID NO: 3853 - DNA, 23 bp, Homo sapiens
cgcctggtccactgtgaagttgg

SEQ ID NO: 3854 - DNA, 26 bp, Homo sapiens
gcctatgaagagcctaaacattggtg

SEQ ID NO: 3855 - DNA, 26 bp, Homo sapiens
tagttcaagttcttctcaaaagcccc

SEQ ID NO: 3856 - DNA, 26 bp, Homo sapiens
acaaggagccaaaggtaaacagactg

SEQ ID NO: 3857 - DNA, 26 bp, Homo sapiens
gcttatttcctgaacgcacttgccta

SEQ ID NO: 3858 - DNA, 26 bp, Homo sapiens
agcatcatacatttcccgcagtttgc

SEQ ID NO: 3859 - DNA, 26 bp, Homo sapiens
ttgtgctacattttcctccctaagag

SEQ ID NO: 3860 - DNA, 23 bp, Homo sapiens
gtgcgggattcagaccttcagca

SEQ ID NO: 3861 - DNA, 23 bp, Homo sapiens
gctgctgggagggtcttacactg

SEQ ID NO: 3862 - DNA, 23 bp, Homo sapiens
ggtgcgggattcagaccttcagc

SEQ ID NO: 3863 - DNA, 23 bp, Homo sapiens
cctcctgtcactgctcctgaaac

SEQ ID NO: 3864 - DNA, 24 bp, Homo sapiens
gggtcacttcccctcattttcccc

SEQ ID NO: 3865 - DNA, 26 bp, Homo sapiens
cattacaaagcagttgggaagaaggg

SEQ ID NO: 3866 - DNA, 26 bp, Homo sapiens
cgtatgggtttgtttgtgtgtgggtt

SEQ ID NO: 3867 - DNA, 26 bp, Homo sapiens
gattagaaacacaagagaccagaggc

SEQ ID NO: 3868 - DNA, 23 bp, Homo sapiens
agcacagaggcagagggaggaag

SEQ ID NO: 3869 - DNA, 23 bp, Homo sapiens
ggtgcgggattcagaccttcagc

SEQ ID NO: 3870 - DNA, 23 bp, Homo sapiens
ggtgcgggattcagaccttcagc

SEQ ID NO: 3871 - DNA, 23 bp, Homo sapiens
gactgctgggtccttttgccgtg

SEQ ID NO: 3872 - DNA, 26 bp, Homo sapiens
ggaaagattgtgggtaggtgctgggt

SEQ ID NO: 3873 - DNA, 21 bp, Homo sapiens
tagaaacataaaatatccttt

SEQ ID NO: 3874 - DNA, 24 bp, Homo sapiens
cacatgggctaagaggccctagaa

SEQ ID NO: 3875 - DNA, 26 bp, Homo sapiens
ggctatgggagggagaggaagaaata

SEQ ID NO: 3876 - DNA, 28 bp, Homo sapiens
ctatggactgcttgggcttcctgacagc

SEQ ID NO: 3877 - DNA, 23 bp, Homo sapiens
ctcagcagacagcagaaaggacc

SEQ ID NO: 3878 - DNA, 28 bp, Homo sapiens
gtttaccaatctctgacatagaccaaca

SEQ ID NO: 3879 - DNA, 23 bp, Homo sapiens
tgttgtcctcccagcctccagag

SEQ ID NO: 3880 - DNA, 26 bp, Homo sapiens
atacgagtggcaggttagttcattat

SEQ ID NO: 3881 - DNA, 23 bp, Homo sapiens
agaaatcactctctgccatctcc

SEQ ID NO: 3882 - DNA, 23 bp, Homo sapiens
ggaaagttcagggctggcagtgc

SEQ ID NO: 3883 - DNA, 26 bp, Homo sapiens
ggttctttcttgttttgctcaccacc

SEQ ID NO: 3884 - DNA, 25 bp, Homo sapiens
gctgaggttgtgtcctggaacagac

SEQ ID NO: 3885 - DNA, 26 bp, Homo sapiens
tttctttgctctcctctctcagcctg

SEQ ID NO: 3886 - DNA, 23 bp, Homo sapiens
gactgctgggctggaaaatcccc

SEQ ID NO: 3887 - DNA, 23 bp, Homo sapiens
ggtgtggatgtctgaggtggaag

SEQ ID NO: 3888 - DNA, 26 bp, Homo sapiens
gggtctccaggtcccattcttttcct

SEQ ID NO: 3889 - DNA, 26 bp, Homo sapiens
ggtatcaggctatttccttctgctac

SEQ ID NO: 3890 - DNA, 23 bp, Homo sapiens
tacacccaaacacagcgactgcg

SEQ ID NO: 3891 - DNA, 26 bp, Homo sapiens
ccacagaactgatgccaagaactggg

SEQ ID NO: 3892 - DNA, 26 bp, Homo sapiens
gttaccgcctttatggcacagcacca

SEQ ID NO: 3893 - DNA, 26 bp, Homo sapiens
gagaccataggcaagcaggttctgtg

SEQ ID NO: 3894 - DNA, 24 bp, Homo sapiens
ggataactccaggactaaggatgc

SEQ ID NO: 3895 - DNA, 26 bp, Homo sapiens
tgagaccgataaaggtagagggtttt

SEQ ID NO: 3896 - DNA, 26 bp, Homo sapiens
ccctcggttccctcactcttttctgt

SEQ ID NO: 3897 - DNA, 23 bp, Homo sapiens
actacctggaaagggagaccccg

SEQ ID NO: 3898 - DNA, 23 bp, Homo sapiens
cagggcttgctttggacaggagt

SEQ ID NO: 3899 - DNA, 23 bp, Homo sapiens
gcctcacaaaagcggcaggacat

SEQ ID NO: 3900 - DNA, 24 bp, Homo sapiens
gtgaggcttgctgattgggcagtc

SEQ ID NO: 3901 - DNA, 23 bp, Homo sapiens
ttggagcaagaaagggaggcacg

SEQ ID NO: 3902 - DNA, 26 bp, Homo sapiens
ggagtccactgaggcagagtagagaa

SEQ ID NO: 3903 - DNA, 26 bp, Homo sapiens
cagtcatctcattcacacattgcctg

SEQ ID NO: 3904 - DNA, 26 bp, Homo sapiens
agcagggagagcattagaccattgtc

SEQ ID NO: 3905 - DNA, 23 bp, Homo sapiens
gtggttggtggacctggcaaaag

SEQ ID NO: 3906 - DNA, 23 bp, Homo sapiens
gcaggcacaatccttcccaatgc

SEQ ID NO: 3907 - DNA, 23 bp, Homo sapiens
caagtgcttcctgaggtgactgc

SEQ ID NO: 3908 - DNA, 60 bp, Homo sapiens
ctcaccacctcctagctatgacccttggtcgattctcaatgtctacgtggactaactcat

SEQ ID NO: 3909 - DNA, 60 bp, Homo sapiens
tatggtaaaatggattctctctcagttctcgaagtggaattgtgaatcttccaatcgtct

SEQ ID NO: 3910 - DNA, 60 bp, Homo sapiens
ggagttggttaactctgtatcacgtatttcgagttcttcttcatcttcattacctttttt

SEQ ID NO: 3911 - DNA, 60 bp, Homo sapiens
tcaattcattgattaggtaaatttgtattcgataaagtggatgaactgatttttagctaa

SEQ ID NO: 3912 - DNA, 60 bp, Homo sapiens
tggttttcccttcctttgttacttcacttcgaaagatgttgagtctatctgtaactcaga

SEQ ID NO: 3913 - DNA, 60 bp, Homo sapiens
tcacatattcatcttctctctcttgctatcgaatctgatactctctgcctttgaactggg

SEQ ID NO: 3914 - DNA, 60 bp, Homo sapiens
atatttttttttttttgtattcccagaatcgacttcttctgttagatgcttgagatggat

SEQ ID NO: 3915 - DNA, 60 bp, Homo sapiens
ttttgaacacatttttaaaactctgagttcgagggcactgatttttccagagtagtggag

SEQ ID NO: 3916 - DNA, 60 bp, Homo sapiens
caaatatcctaataaacaaattcctgtgtcgattcctttgttttctgcatattgggacac

SEQ ID NO: 3917 - DNA, 60 bp, Homo sapiens
tctatataagaaattcgtaggatgaatatcgaatgaaactaacagaggaagaaaaacatt

SEQ ID NO: 3918 - DNA, 60 bp, Homo sapiens
aatcacatactaacatctctcatgaaaatcgatgatttcttttatgcttacagaagtcca

SEQ ID NO: 3919 - DNA, 60 bp, Homo sapiens
ccttttaaaaggctaaatttctggacattcgaaggacaatattcttcaagtatatattgt

SEQ ID NO: 3920 - DNA, 60 bp, Homo sapiens
taagatactagaaaccaacataaattaatcgaggctgtaagtaaatctgaagtaatcggg

SEQ ID NO: 3921 - DNA, 60 bp, Homo sapiens
ccccactctgccctcaattgtggttcattcgataaatatgtgttgaatctaagagagtgt

SEQ ID NO: 3922 - DNA, 60 bp, Homo sapiens
aaaaaactatcttatactcctcacttcttcgactcgctgacaccaccccaccccacccct

SEQ ID NO: 3923 - DNA, 60 bp, Homo sapiens
atgctaaattatgtaaaatggaatatgttcgagatgactgcagtcttccaccaacagctt

SEQ ID NO: 3924 - DNA, 60 bp, Homo sapiens
ctgtcaattctgtatgttgagaaattcatcgaataatttttaaatttttgtagagatggg

SEQ ID NO: 3925 - DNA, 60 bp, Homo sapiens
ggactcagtctctccaggagagactttatcgaaatgtatccacccaccccacctctaaac

SEQ ID NO: 3926 - DNA, 60 bp, Homo sapiens
cactctagtccactactagttgcaatgttcgattttatttattcatagtgagttgaagtc

SEQ ID NO: 3927 - DNA, 60 bp, Homo sapiens
aagaataggtctttcggtattatttagttcgaagttagtgtcagtggtcaacttctcccg

SEQ ID NO: 3928 - DNA, 60 bp, Homo sapiens
ctagattcccagaagaaagattactgattcgatcattgctcaatgaccaagtcacaaagt

SEQ ID NO: 3929 - DNA, 60 bp, Homo sapiens
ttgcattggtgcaaaaaatgcaatcaaatcgagcctactatatatatttagctttgactt

SEQ ID NO: 3930 - DNA, 60 bp, Homo sapiens
tattataattgacttatttttccattattcgaagtccatagttgacattataattcagtc

SEQ ID NO: 3931 - DNA, 60 bp, Homo sapiens
tgttttcttttaacatcctattattgactcgattttctctctgtaagatgaacaagttta

SEQ ID NO: 3932 - DNA, 60 bp, Homo sapiens
acctcggcttaggaatgtggcttcaatctcgactcgctgacaccaccccaccccacccct

SEQ ID NO: 3933 - DNA, 60 bp, Homo sapiens
tcatgaaatgattgagttgtgaatttcatcgagatatgcattattaatgtttaaactgtg

SEQ ID NO: 3934 - DNA, 60 bp, Homo sapiens
atgtaatcatcatcatcatactttataatcgatatcatcctatacaatgcttagctctca

SEQ ID NO: 3935 - DNA, 60 bp, Homo sapiens
ctcaccacctcctagctatgacccttggtcgattcaattgctaggcagatgtccttgtag

SEQ ID NO: 3936 - DNA, 60 bp, Homo sapiens
gatgagtaacatagtagaaaaaaatacttcgaaactgtcactctggtgttgagataaata

SEQ ID NO: 3937 - DNA, 60 bp, Homo sapiens
cttatctttatttgctgtctttacatcttcgaaagatttaatgaagtggattctaatgaa

SEQ ID NO: 3938 - DNA, 60 bp, Homo sapiens
ttatctttataaatcataccatatagcttcgactccaaatgcagaatgtaactcatgagc

SEQ ID NO: 3939 - DNA, 60 bp, Homo sapiens
tcttctaaagacaagtcccagtttaagatcgatgaattcaaggaaatatattcaggtcac

SEQ ID NO: 3940 - DNA, 60 bp, Homo sapiens
tgaatttatttcatgttctcttctaatgtcgaattacagtctcaggcttgacaaaaccta

SEQ ID NO: 3941 - DNA, 60 bp, Homo sapiens
cactccttcatcccacccccacacatactcgaaattaaatgtgtgatccatcctagtatt

SEQ ID NO: 3942 - DNA, 60 bp, Homo sapiens
gatttcaatgtagatcttcaaactctcatcgatttttcaatgtttgtgacaaaaccggtt

SEQ ID NO: 3943 - DNA, 60 bp, Homo sapiens
taaaatggctacatttttttttccattctcgaatttagagatgaacacacgttctgcctc

SEQ ID NO: 3944 - DNA, 60 bp, Homo sapiens
gaactctcagagtggttgcaaagattattcgacccgctttcctccccgccccctcatccg

SEQ ID NO: 3945 - DNA, 60 bp, Homo sapiens
ctgggtacccttatgtaaaataaatttatcgacttaaaagtctccataaaggaacgctac

SEQ ID NO: 3946 - DNA, 60 bp, Homo sapiens
cccgattacttcagatttacttacagcctcgatgaacttcctctgcttctagagctttta

SEQ ID NO: 3947 - DNA, 60 bp, Homo sapiens
ctcaccacctcctagctatgacccttggtcgataagaaagactgtattctcaaggaattc

SEQ ID NO: 3948 - DNA, 60 bp, Homo sapiens
aaggagtgcacatttccacttagagaactcgaaatgtatccacccaccccacctctaaac

SEQ ID NO: 3949 - DNA, 60 bp, Homo sapiens
agactattctttcaacatttaaagatactcgaggacagggaatagaaatgctttcaaaga

SEQ ID NO: 3950 - DNA, 60 bp, Homo sapiens
atgagtcaagaattcagaaagagtgcaatcgacctacattttctttgtctttgtaatgga

SEQ ID NO: 3951 - DNA, 60 bp, Homo sapiens
tcaatttattgagtctaatttacatacatcgatatcatcctatacaatgcttagctctca

SEQ ID NO: 3952 - DNA, 60 bp, Homo sapiens
catcttccctacccatctccccaccctctcgaatttagactgcttaccacattgatgttt

SEQ ID NO: 3953 - DNA, 60 bp, Homo sapiens
ttatctcaagatctttaacttaattacatcgataattgagcagctggcatttttttttcc

SEQ ID NO: 3954 - DNA, 60 bp, Homo sapiens
ttccccactgcctcccatcctttatctctcgaagtagtccttgtacctaccatgatcatc

SEQ ID NO: 3955 - DNA, 60 bp, Homo sapiens
atattctttcaatatttgtacatttatatcgaagcagagatgtcttgcagtcagagtcaa

SEQ ID NO: 3956 - DNA, 60 bp, Homo sapiens
cacagaatagactctcagtaaataactatcgaatttaatctgcgtctgatatgctggcag

SEQ ID NO: 3957 - DNA, 60 bp, Homo sapiens
ctcaccacctcctagctatgacccttggtcgacaagagcctcctgacaggtctgcctgcc

SEQ ID NO: 3958 - DNA, 60 bp, Homo sapiens
tcaatcaggaatcactgtaaatattgactcgaggtgtagagaaaaccctggaaggggggt

SEQ ID NO: 3959 - DNA, 26 bp, Homo sapiens
aagagcacggacaccaaacaggtcta

SEQ ID NO: 3960 - DNA, 26 bp, Homo sapiens
gctggcttgggattgtgttgaaccac

SEQ ID NO: 3961 - DNA, 26 bp, Homo sapiens
actaagaagtcagggaaggtaagccc

SEQ ID NO: 3962 - DNA, 23 bp, Homo sapiens
gccctggataggacctggcagat

SEQ ID NO: 3963 - DNA, 26 bp, Homo sapiens
cctgagtccccaaagtccattagtcc

SEQ ID NO: 3964 - DNA, 26 bp, Homo sapiens
tgtgtgtaagttcccttccccgacta

SEQ ID NO: 3965 - DNA, 23 bp, Homo sapiens
cctcacacagtcctcttcccacc

SEQ ID NO: 3966 - DNA, 24 bp, Homo sapiens
tagaacccatagcaccaagtccat

SEQ ID NO: 3967 - DNA, 26 bp, Homo sapiens
tttggtgtatggtgtagtaacctcac

SEQ ID NO: 3968 - DNA, 26 bp, Homo sapiens
ccttcttctccttgcctttcctctgg

SEQ ID NO: 3969 - DNA, 26 bp, Homo sapiens
ccaaatccagacaaggacattcaaga

SEQ ID NO: 3970 - DNA, 26 bp, Homo sapiens
tcctaccttgggagtgagtgaaagag

SEQ ID NO: 3971 - DNA, 26 bp, Homo sapiens
gtgtaagcagtttatggtcagagtct

SEQ ID NO: 3972 - DNA, 26 bp, Homo sapiens
tttacagccccaccagcaacacagga

SEQ ID NO: 3973 - DNA, 23 bp, Homo sapiens
gcagtgacgggcataagatggac

SEQ ID NO: 3974 - DNA, 26 bp, Homo sapiens
ttggcaaaacaacttcccactgacct

SEQ ID NO: 3975 - DNA, 23 bp, Homo sapiens
gccagcaagagccagagacacaa

SEQ ID NO: 3976 - DNA, 26 bp, Homo sapiens
gtcaccctgtattgccatagcagcat

SEQ ID NO: 3977 - DNA, 26 bp, Homo sapiens
aactaaccaggaaaacgacatagcac

SEQ ID NO: 3978 - DNA, 26 bp, Homo sapiens
gtgaaggctactgacaaaaggtatgg

SEQ ID NO: 3979 - DNA, 26 bp, Homo sapiens
ctctatttggcatcctttccttaggc

SEQ ID NO: 3980 - DNA, 26 bp, Homo sapiens
aatgtctatctcagcagagtcacaga

SEQ ID NO: 3981 - DNA, 26 bp, Homo sapiens
ttagaacttccattgtgcccttcgcc

SEQ ID NO: 3982 - DNA, 26 bp, Homo sapiens
agcagttacagttttgaagcagggct

SEQ ID NO: 3983 - DNA, 23 bp, Homo sapiens
acctctgtttgagtgaccctggg

SEQ ID NO: 3984 - DNA, 26 bp, Homo sapiens
gaagtgacagagaaggtgccatttac

SEQ ID NO: 3985 - DNA, 23 bp, Homo sapiens
agcgaggtcaataacacccaggg

SEQ ID NO: 3986 - DNA, 26 bp, Homo sapiens
aagagcacggacaccaaacaggtcta

SEQ ID NO: 3987 - DNA, 24 bp, Homo sapiens
gctggtgtgccactaatgctctcc

SEQ ID NO: 3988 - DNA, 26 bp, Homo sapiens
tcatctccacccctccactgaaacta

SEQ ID NO: 3989 - DNA, 23 bp, Homo sapiens
agaaggctgggtgtccaagcagg

SEQ ID NO: 3990 - DNA, 23 bp, Homo sapiens
aggtccttgacactctccctccg

SEQ ID NO: 3991 - DNA, 26 bp, Homo sapiens
cggagaccaccatacaatagtgctgc

SEQ ID NO: 3992 - DNA, 24 bp, Homo sapiens
ttctgaatgacagggctggagcgg

SEQ ID NO: 3993 - DNA, 24 bp, Homo sapiens
cccctcttctcctgggtttatggg

SEQ ID NO: 3994 - DNA, 26 bp, Homo sapiens
gtaagtccttcctactgtgcctttgg

SEQ ID NO: 3995 - DNA, 23 bp, Homo sapiens
gcctctatgtgcctgttccacca

SEQ ID NO: 3996 - DNA, 24 bp, Homo sapiens
ctccaggattcattccagccttcc

SEQ ID NO: 3997 - DNA, 26 bp, Homo sapiens
gcttatttcctgaacgcacttgccta

SEQ ID NO: 3998 - DNA, 23 bp, Homo sapiens
gagcacggacaccaaacaggtct

SEQ ID NO: 3999 - DNA, 26 bp, Homo sapiens
gttccttgcctcacagactctaccac

SEQ ID NO: 4000 - DNA, 25 bp, Homo sapiens
ggaacagttgtggtgtgctaaaacg

SEQ ID NO: 4001 - DNA, 26 bp, Homo sapiens
gaggagcattctggttatctatcacc

SEQ ID NO: 4002 - DNA, 23 bp, Homo sapiens
gcttcttcctctgtcccatagcg

SEQ ID NO: 4003 - DNA, 26 bp, Homo sapiens
atcagtctttcaccaggagcccttcc

SEQ ID NO: 4004 - DNA, 23 bp, Homo sapiens
tggcttccctctgtctcctcctc

SEQ ID NO: 4005 - DNA, 23 bp, Homo sapiens
gggagatgaatgggtgaggcgat

SEQ ID NO: 4006 - DNA, 26 bp, Homo sapiens
atggatagatggcagaggaacacagc

SEQ ID NO: 4007 - DNA, 26 bp, Homo sapiens
ggattcccagattgaaaacagtgcca

SEQ ID NO: 4008 - DNA, 23 bp, Homo sapiens
ctctatgtcctccccacagcctg

SEQ ID NO: 4009 - DNA, 23 bp, Homo sapiens
ggagggagaaagtcaggagagag

SEQ ID NO: 4010 - DNA, 26 bp, Homo sapiens
ctcagccttaggaggatgtgactatc

SEQ ID NO: 4011 - DNA, 26 bp, Homo sapiens
ttttctcaaacgagtcccacccaata

SEQ ID NO: 4012 - DNA, 26 bp, Homo sapiens
ctaatacgaaaaccaaggaataccct

SEQ ID NO: 4013 - DNA, 23 bp, Homo sapiens
ctgactctcttgggtgcttgagc

SEQ ID NO: 4014 - DNA, 26 bp, Homo sapiens
ctcatagaaaagggtagaaagcagag

SEQ ID NO: 4015 - DNA, 26 bp, Homo sapiens
gaaggacaaagagcagatggaacaaa

SEQ ID NO: 4016 - DNA, 23 bp, Homo sapiens
gagtcagcctatgggacacagca

SEQ ID NO: 4017 - DNA, 23 bp, Homo sapiens
gtgtcttaggcacatcattcagc

SEQ ID NO: 4018 - DNA, 26 bp, Homo sapiens
ctctaccattttctgcttcctccgcc

SEQ ID NO: 4019 - DNA, 26 bp, Homo sapiens
ggagttcaacaaagtggtgggaatct

SEQ ID NO: 4020 - DNA, 24 bp, Homo sapiens
cccaggagcccagttgaagaccat

SEQ ID NO: 4021 - DNA, 26 bp, Homo sapiens
gacacctgctggttgagagtgacaat

SEQ ID NO: 4022 - DNA, 26 bp, Homo sapiens
gcttatttcctgaacgcacttgccta

SEQ ID NO: 4023 - DNA, 26 bp, Homo sapiens
gagagaagtgagagaaagttgggact

SEQ ID NO: 4024 - DNA, 23 bp, Homo sapiens
tgtgctctccctccccaatgtgc

SEQ ID NO: 4025 - DNA, 26 bp, Homo sapiens
ggtggctctggctgatggtctttcat

SEQ ID NO: 4026 - DNA, 23 bp, Homo sapiens
tgaggagatggctggacacggca

SEQ ID NO: 4027 - DNA, 26 bp, Homo sapiens
ggctctgaacctctccttggaacaat

SEQ ID NO: 4028 - DNA, 25 bp, Homo sapiens
ccttccaagagggtctggcattctc

SEQ ID NO: 4029 - DNA, 26 bp, Homo sapiens
cagcctactcctgctaaagggaaagg

SEQ ID NO: 4030 - DNA, 26 bp, Homo sapiens
ggcagaaatgtaaggagcacacctgg

SEQ ID NO: 4031 - DNA, 26 bp, Homo sapiens
ctaccccagatggctgtgaggattac

SEQ ID NO: 4032 - DNA, 26 bp, Homo sapiens
ggagttatgggaagaggaagggatga

SEQ ID NO: 4033 - DNA, 26 bp, Homo sapiens
tgtggcatttgaggcagagcgagcaa

SEQ ID NO: 4034 - DNA, 23 bp, Homo sapiens
tgtgctctccctccccaatgtgc

SEQ ID NO: 4035 - DNA, 26 bp, Homo sapiens
cctctccccacacatacacctaactc

SEQ ID NO: 4036 - DNA, 23 bp, Homo sapiens
cggtgctgggcttgccataacac

SEQ ID NO: 4037 - DNA, 26 bp, Homo sapiens
tggagtcacttgtgtcaaaaccctga

SEQ ID NO: 4038 - DNA, 23 bp, Homo sapiens
ttcatcttcccacctcccctgga

SEQ ID NO: 4039 - DNA, 26 bp, Homo sapiens
gtagtccctgaagagcaatctcaagg

SEQ ID NO: 4040 - DNA, 23 bp, Homo sapiens
ccatcttgagacagcacctctgg

SEQ ID NO: 4041 - DNA, 23 bp, Homo sapiens
tgggcttgtgttcaggctctgtg

SEQ ID NO: 4042 - DNA, 26 bp, Homo sapiens
cttgagagaagtccatctaatagggc

SEQ ID NO: 4043 - DNA, 26 bp, Homo sapiens
agtgggtcacgaaacagaagaactct

SEQ ID NO: 4044 - DNA, 23 bp, Homo sapiens
gctttgcttcacaggcttgccca

SEQ ID NO: 4045 - DNA, 26 bp, Homo sapiens
caggatggttagaatgaccgccttgt

SEQ ID NO: 4046 - DNA, 23 bp, Homo sapiens
ttattgctccccacaccccaccc

SEQ ID NO: 4047 - DNA, 23 bp, Homo sapiens
agttactgtggctggctgggctg

SEQ ID NO: 4048 - DNA, 26 bp, Homo sapiens
caccagagagagggaaatacaggctg

SEQ ID NO: 4049 - DNA, 23 bp, Homo sapiens
aacacagtccacctgcccctcag

SEQ ID NO: 4050 - DNA, 26 bp, Homo sapiens
gaagttagcacaaaaggaacctggag

SEQ ID NO: 4051 - DNA, 23 bp, Homo sapiens
tggaccctgtgcctcccactgtg

SEQ ID NO: 4052 - DNA, 26 bp, Homo sapiens
gactgcctgttttccagccatttccc

SEQ ID NO: 4053 - DNA, 23 bp, Homo sapiens
cggtgctgggcttgccataacac

SEQ ID NO: 4054 - DNA, 26 bp, Homo sapiens
agttactgcctcaagacacactcaat

SEQ ID NO: 4055 - DNA, 23 bp, Homo sapiens
gcctctcagactggcttccaaac

SEQ ID NO: 4056 - DNA, 23 bp, Homo sapiens
gtgctcttggtctcctcagcctc

SEQ ID NO: 4057 - DNA, 26 bp, Homo sapiens
caaggaggagaaacaggagaaggtag

SEQ ID NO: 4058 - DNA, 26 bp, Homo sapiens
gcgagagagaagagaggcatccacat

SEQ ID NO: 4059 - DNA, 23 bp, Homo sapiens
tttcagccaagggtcaaggtggg

SEQ ID NO: 4060 - DNA, 23 bp, Homo sapiens
ctgcctgcccatagtcaccagca

SEQ ID NO: 4061 - DNA, 60 bp, Homo sapiens
atgacaaatgtaaagaatacaaaagtaatcgatcttacctggactactagcattccaact

SEQ ID NO: 4062 - DNA, 60 bp, Homo sapiens
tgcttctttttctttctgaggccaaatctcgagtccatgtgtttctgattcgtttttatt

SEQ ID NO: 4063 - DNA, 60 bp, Homo sapiens
aataagaaagaattctctctatctgtcttcgatagctcatttctttttattgttgcttaa

SEQ ID NO: 4064 - DNA, 60 bp, Homo sapiens
taaacttttaaagaaagcaagaattgcatcgaagtttacgttaggcctctctcttaggtt

SEQ ID NO: 4065 - DNA, 60 bp, Homo sapiens
tctttcctaatataagcattaaaatctatcgatgattaaaccagaaaggaaaacaaaaga

SEQ ID NO: 4066 - DNA, 60 bp, Homo sapiens
ctcaccacctcctagctatgacccttggtcgagaggcaagaaatgcttcaaccgtgcaat

SEQ ID NO: 4067 - DNA, 60 bp, Homo sapiens
gtcttctttgtgtggaggaagcagtttctcgaccccctgcccctcactgagccttagttt

SEQ ID NO: 4068 - DNA, 60 bp, Homo sapiens
ccccactctgccctcaattgtggttcattcgaactttcttctaaaaagcctaaaatactt

SEQ ID NO: 4069 - DNA, 60 bp, Homo sapiens
tacattgattacagaaaatcttgttatttcgacaaaataaatgtagtagaatttctttga

SEQ ID NO: 4070 - DNA, 60 bp, Homo sapiens
gctgccttctttccattgatgtttcaattcgagactccttctcaaaaacaaaaacaacca

SEQ ID NO: 4071 - DNA, 60 bp, Homo sapiens
acactgcctcctctctttgtccctctagtcgaactattttgcaactttagctcctatcct

SEQ ID NO: 4072 - DNA, 60 bp, Homo sapiens
atctatccattatctatctacctatttctcgatttaaaaaaaataaaaataaataaataa

SEQ ID NO: 4073 - DNA, 60 bp, Homo sapiens
attagaatattatcctcacatttctaggtcgatataccataggtgtatagtaggttatgc

SEQ ID NO: 4074 - DNA, 60 bp, Homo sapiens
attacaatttttgatcacactgtaattttcgaactcaacaggtcctaaaaagctgccttc

SEQ ID NO: 4075 - DNA, 60 bp, Homo sapiens; identical to SEQ ID NO: 1158

SEQ ID NO: 4076 - DNA, 60 bp, Homo sapiens; identical to SEQ ID NO: 1117

SEQ ID NO: 4077 - DNA, 60 bp, Homo sapiens; identical to SEQ ID NO: 1356

SEQ ID NO: 4078 - DNA, 60 bp, Homo sapiens; identical to SEQ ID NO: 1383

SEQ ID NO: 4079 - DNA, 60 bp, Homo sapiens; identical to SEQ ID NO: 1157

SEQ ID NO: 4080 - DNA, 60 bp, Homo sapiens; identical to SEQ ID NO: 1408

SEQ ID NO: 4081 - DNA, 60 bp, Homo sapiens; identical to SEQ ID NO: 1110

SEQ ID NO: 4082 - DNA, 60 bp, Homo sapiens; identical to SEQ ID NO: 1365

SEQ ID NO: 4083 - DNA, 60 bp, Homo sapiens; identical to SEQ ID NO: 1122

SEQ ID NO: 4084 - DNA, 60 bp, Homo sapiens; identical to SEQ ID NO: 1354

SEQ ID NO: 4085 - DNA, 60 bp, Homo sapiens; identical to SEQ ID NO: 1096

SEQ ID NO: 4086 - DNA, 60 bp, Homo sapiens; identical to SEQ ID NO: 1358

SEQ ID NO: 4087 - DNA, 60 bp, Homo sapiens; identical to SEQ ID NO: 1112

SEQ ID NO: 4088 - DNA, 60 bp, Homo sapiens; identical to SEQ ID NO: 1082

SEQ ID NO: 4089 - DNA, 60 bp, Homo sapiens; identical to SEQ ID NO: 1345

SEQ ID NO: 4090 - DNA, 60 bp, Homo sapiens; identical to SEQ ID NO: 1154

SEQ ID NO: 4091 - DNA, 26 bp, Homo sapiens
gctaaaagaagaaaacgatgaggagc

SEQ ID NO: 4092 - DNA, 26 bp, Homo sapiens
ttttgtcttcctgcccctcttcctgc

SEQ ID NO: 4093 - DNA, 26 bp, Homo sapiens
gggactgaatagagcaggaagacgga

SEQ ID NO: 4094 - DNA, 26 bp, Homo sapiens
ggacagattgtgaggcacccttggat

SEQ ID NO: 4095 - DNA, 23 bp, Homo sapiens
ctttctgaggtggaagccctgat

SEQ ID NO: 4096 - DNA, 26 bp, Homo sapiens
aagagcacggacaccaaacaggtcta

SEQ ID NO: 4097 - DNA, 23 bp, Homo sapiens
gtggaggaggtcaagacttcagc

SEQ ID NO: 4098 - DNA, 23 bp, Homo sapiens
caccagcaacacaggagaggacc

SEQ ID NO: 4099 - DNA, 26 bp, Homo sapiens
ctgagtcggatgaacagatggtctac

SEQ ID NO: 4100 - DNA, 26 bp, Homo sapiens
atcttcctctccttcaatggatggct

SEQ ID NO: 4101 - DNA, 26 bp, Homo sapiens
acagtggctaaatctcctccctggct

SEQ ID NO: 4102 - DNA, 26 bp, Homo sapiens
cttctatcttccatctacctgtctat

SEQ ID NO: 4103 - DNA, 26 bp, Homo sapiens
aggactgccaggaacaaagagccact

SEQ ID NO: 4104 - DNA, 23 bp, Homo sapiens
tccattcattctccagcccaggg

SEQ ID NO: 4105 - DNA, 26 bp, Homo sapiens
cacagcaacaaaagcaacctggtgtc

SEQ ID NO: 4106 - DNA, 26 bp, Homo sapiens
gagactgaggttgcttccaatgttcc

SEQ ID NO: 4107 - DNA, 26 bp, Homo sapiens
gaagagaccttatccttttgaactac

SEQ ID NO: 4108 - DNA, 26 bp, Homo sapiens
ggaaatggtggcgggaaggagaaatg

SEQ ID NO: 4109 - DNA, 23 bp, Homo sapiens
gcattccaggtccaagatgtcct

SEQ ID NO: 4110 - DNA, 26 bp, Homo sapiens
ggaactacagtgtcttctacagggac

SEQ ID NO: 4111 - DNA, 26 bp, Homo sapiens
gacatagaataatctccatccattgc

SEQ ID NO: 4112 - DNA, 26 bp, Homo sapiens
tgagaggttatgacttttccgaggtc

SEQ ID NO: 4113 - DNA, 26 bp, Homo sapiens
gcctaagtccagtagtatggtggctg

SEQ ID NO: 4114 - DNA, 23 bp, Homo sapiens
ggttgctggctggagtcttctga

SEQ ID NO: 4115 - DNA, 26 bp, Homo sapiens
tgtagagccaaatagccacagggata

SEQ ID NO: 4116 - DNA, 26 bp, Homo sapiens
actctggctccgtttcttccctgact

SEQ ID NO: 4117 - DNA, 23 bp, Homo sapiens
cctcacacagtcctcttcccacc

SEQ ID NO: 4118 - DNA, 23 bp, Homo sapiens
tggagaggtggagggaggtagga

SEQ ID NO: 4119 - DNA, 26 bp, Homo sapiens
gcttagatgtggctttgtcttttctc

SEQ ID NO: 4120 - DNA, 26 bp, Homo sapiens
cttcttctccttgcctttcctctgga

SEQ ID NO: 4121 - DNA, 26 bp, Homo sapiens
gtcattggagagtgtcgggcacagat

SEQ ID NO: 4122 - DNA, 26 bp, Homo sapiens
ggttcggcagaatctttggacatcaa

SEQ ID NO: 4123 - DNA, 26 bp, Homo sapiens
gcacatctgaatgaccttctaagagc

SEQ ID NO: 4124 - DNA, 26 bp, Homo sapiens
ctcccgactttcttcaggtttgtaac

SEQ ID NO: 4125 - DNA, 26 bp, Homo sapiens
gcttgaaaatctcactgttggtccac

SEQ ID NO: 4126 - DNA, 26 bp, Homo sapiens
ggagcaaagaaaggaaactgaagccc

SEQ ID NO: 4127 - DNA, 23 bp, Homo sapiens
ggagatggtgagcccaaggcaga

SEQ ID NO: 4128 - DNA, 23 bp, Homo sapiens
gccttgtcttgcccttgagtctc

SEQ ID NO: 4129 - DNA, 23 bp, Homo sapiens
ctcttctgtttgtgagggctgcc

SEQ ID NO: 4130 - DNA, 26 bp, Homo sapiens
gcccaaagattacatccattctggta

SEQ ID NO: 4131 - DNA, 26 bp, Homo sapiens
cagaagttccctgttgaggtctatct

SEQ ID NO: 4132 - DNA, 26 bp, Homo sapiens
gttcaggaggtctggttacagttcca

SEQ ID NO: 4133 - DNA, 26 bp, Homo sapiens
ctctaagtaaatcctggtcattcccc

SEQ ID NO: 4134 - DNA, 23 bp, Homo sapiens
ggaccgaggaggagagagagcaa

SEQ ID NO: 4135 - DNA, 26 bp, Homo sapiens
ccaccgatttattgccctgtaggaca

SEQ ID NO: 4136 - DNA, 26 bp, Homo sapiens
tcctcagatgatgtttcggcatttgc

SEQ ID NO: 4137 - DNA, 25 bp, Homo sapiens
gagtttcaagtgccctactggctga

SEQ ID NO: 4138 - DNA, 26 bp, Homo sapiens
tcatcatcgtggacaaggaaagccta

SEQ ID NO: 4139 - DNA, 26 bp, Homo sapiens
gtggtgtgagttcaggagggtttagg

SEQ ID NO: 4140 - DNA, 26 bp, Homo sapiens
ttcaactggtaagacattctgaggaa

SEQ ID NO: 4141 - DNA, 26 bp, Homo sapiens
ctaagtccagtagtatggtggctgtg

SEQ ID NO: 4142 - DNA, 26 bp, Homo sapiens
gaagacatacacagtaagccctctgc

SEQ ID NO: 4143 - DNA, 26 bp, Homo sapiens
caagtcctcatctgtagagtctggat

SEQ ID NO: 4144 - DNA, 23 bp, Homo sapiens
ccaaccaaatgggaggcaacgcc

SEQ ID NO: 4145 - DNA, 26 bp, Homo sapiens
ttgaggcaggaagaaaggtttatggc

SEQ ID NO: 4146 - DNA, 26 bp, Homo sapiens
aatactggcaagaacccatctactgc

SEQ ID NO: 4147 - DNA, 23 bp, Homo sapiens
gcctgtcactccaatctgtggtg

SEQ ID NO: 4148 - DNA, 23 bp, Homo sapiens
tgtcctcccttctcttgctcagc

SEQ ID NO: 4149 - DNA, 26 bp, Homo sapiens
gacctggctactcttgaaacacccac

SEQ ID NO: 4150 - DNA, 26 bp, Homo sapiens
ggagaaaagacaaaccagggaaaggg

SEQ ID NO: 4151 - DNA, 60 bp, Homo sapiens
gtgtctgttcaaattctttacccatttttcgatgctttacttttgagtttgggggatgtc

SEQ ID NO: 4152 - DNA, 60 bp, Homo sapiens; identical to SEQ ID NO: 1127

SEQ ID NO: 4153 - DNA, 60 bp, Homo sapiens; identical to SEQ ID NO: 1334

SEQ ID NO: 4154 - DNA, 60 bp, Homo sapiens; identical to SEQ ID NO: 1398

SEQ ID NO: 4155 - DNA, 60 bp, Homo sapiens; identical to SEQ ID NO: 1092

SEQ ID NO: 4156 - DNA, 60 bp, Homo sapiens; identical to SEQ ID NO: 1098

SEQ ID NO: 4157 - DNA, 60 bp, Homo sapiens; identical to SEQ ID NO: 1348

SEQ ID NO: 4158 - DNA, 60 bp, Homo sapiens
tttaaatattttaaatatttttaaaatatcgattctactcctccaggttgcaggcagagc

SEQ ID NO: 4159 - DNA, 60 bp, Homo sapiens; identical to SEQ ID NO: 1097

SEQ ID NO: 4160 - DNA, 60 bp, Homo sapiens; identical to SEQ ID NO: 1152

SEQ ID NO: 4161 - DNA, 60 bp, Homo sapiens; identical to SEQ ID NO: 1353

SEQ ID NO: 4162 - DNA, 60 bp, Homo sapiens; identical to SEQ ID NO: 1150

SEQ ID NO: 4163 - DNA, 60 bp, Homo sapiens; identical to SEQ ID NO: 1338

SEQ ID NO: 4164 - DNA, 60 bp, Homo sapiens; identical to SEQ ID NO: 1355

SEQ ID NO: 4165 - DNA, 60 bp, Homo sapiens; identical to SEQ ID NO: 1083

SEQ ID NO: 4166 - DNA, 60 bp, Homo sapiens
atgaacaggatatgtaataatggtattatcgagtcccttaaaaaattttaaagggggaaa

SEQ ID NO: 4167 - DNA, 60 bp, Homo sapiens
attgtgacaatcacattttaagtactcttcgatattcccgtgttcattgttaattgtttt

SEQ ID NO: 4168 - DNA, 60 bp, Homo sapiens
ttgcttttttatttttattttttatttttcgacctcacatgcctcttacataggcttgaa

SEQ ID NO: 4169 - DNA, 60 bp, Homo sapiens
atcttctttttttcaaaagtatcctaagtcgaagacgcacatttttttcacatttcaaca

SEQ ID NO: 4170 - DNA, 60 bp, Homo sapiens
ccagagtagtaaaattgtgctttctaattcgaatacttcctggactcatcaaattaaatg

SEQ ID NO: 4171 - DNA, 60 bp, Homo sapiens
agatcccttgtacactgtatactgtttgtcgaatacatttttctctttgagtgggaagaa

SEQ ID NO: 4172 - DNA, 60 bp, Homo sapiens
gtctcagttccactgagcatcttgtacttcgagtattatgtactatacgtaattgtatgt

SEQ ID NO: 4173 - DNA, 60 bp, Homo sapiens
gcatttttatgaaattaaatgtccgtattcgagattttcaccaataagctgagtgggagg

SEQ ID NO: 4174 - DNA, 60 bp, Homo sapiens; identical to SEQ ID NO: 4168

SEQ ID NO: 4175 - DNA, 60 bp, Homo sapiens
gtgtgttaatagaagtaatatcacactatcgatatacctttgccacatgacctatcaata

SEQ ID NO: 4176 - DNA, 60 bp, Homo sapiens
tgggtatattttctttttgtttggaaactcgactagaaaaactggcagaaaggttagcag

SEQ ID NO: 4177 - DNA, 60 bp, Homo sapiens
acacattcctttcttaagaaatgttaactcgagaccatctcccccggagacggtaccggg

SEQ ID NO: 4178 - DNA, 60 bp, Homo sapiens
ttttttttttttaacatctgtcttctcttcgagctccgcgcgccgaccacgggcagcggg

SEQ ID NO: 4179 - DNA, 60 bp, Homo sapiens
gtagtttttaattttgaagtccaatttatcgacatctgatttcatttcccttggatatat

SEQ ID NO: 4180 - DNA, 60 bp, Homo sapiens
taaaattttttttaagaagaaaaaagactcgactgattgatcaatttagtccttcttgag

SEQ ID NO: 4181 - DNA, 60 bp, Homo sapiens
ccatctttaacaagtggtaaattttttctcgagaaatattccaagacctcgtttgaatac

SEQ ID NO: 4182 - DNA, 60 bp, Homo sapiens
catgtatgaaatatgaaatttggaagaatcgactgccactatttcacaggtgatgacctg

SEQ ID NO: 4183 - DNA, 60 bp, Homo sapiens
catgatacaaattgtactgccatttccatcgacttaggtaaaaaacttgacaagagacaa

SEQ ID NO: 4184 - DNA, 60 bp, Homo sapiens
gatatttgtagtggcatttttttttttttcgaatcttgtgaatgtattaaatatatcgct

SEQ ID NO: 4185 - DNA, 60 bp, Homo sapiens
tttgtacaatttgttttgtagtttcaactcgatgatcagcaagagcttttcttcttgctg

SEQ ID NO: 4186 - DNA, 60 bp, Homo sapiens
tttttatctcttctagattttgtcttcctcgatgttgctgatgctaccaggcttaacagg

SEQ ID NO: 4187 - DNA, 60 bp, Homo sapiens; identical to SEQ ID NO: 1624

SEQ ID NO: 4188 - DNA, 60 bp, Homo sapiens
atgagaaacctaaggtcagttctggctttcgatacaaagattataaataaaattggctgg

SEQ ID NO: 4189 - DNA, 60 bp, Homo sapiens
aaccggttttgtcacaaacattgaaaaatcgattatgaactcagagaccaggaaaatgaa

SEQ ID NO: 4190 - DNA, 60 bp, Homo sapiens
tgccgcattttttgaataaattcacacatcgaagaaaatgctgaagaatatcttaatgac

SEQ ID NO: 4191 - DNA, 60 bp, Homo sapiens
catcatcagtttatttttggagttacattcgaaaccctgctttattttatttattttttt

SEQ ID NO: 4192 - DNA, 60 bp, Homo sapiens
agctaaaaacttttcaaattgatagatttcgagaccatcttggccaagatggtgaaatcc

SEQ ID NO: 4193 - DNA, 60 bp, Homo sapiens; identical to SEQ ID NO: 1680

SEQ ID NO: 4194 - DNA, 60 bp, Homo sapiens
tgttttgtccagaaataagacacagatgtcgactttagctcattttccacctttctctga

SEQ ID NO: 4195 - DNA, 60 bp, Homo sapiens
ttctcaaactcttcttatgttcaaactgtcgatctctggctttggcttcccaaagcactg

SEQ ID NO: 4196 - DNA, 60 bp, Homo sapiens
attacattaagtgaaatgttaacttcattcgatattcccgtgttcattgttaattgtttt

SEQ ID NO: 4197 - DNA, 60 bp, Homo sapiens
agtatggaatatactttagataatagtgtcgactacagaaaaaatattcccagcacgtaa

SEQ ID NO: 4198 - DNA, 60 bp, Homo sapiens
ttgctttaataggaaaatgaaaaacctgtcgagctccgcgcgccgaccacgggcagcggg

SEQ ID NO: 4199 - DNA, 60 bp, Homo sapiens
tcaaatttcaacataagatttgaaaaagtcgaatatatattaaacatctacactgtgtca

SEQ ID NO: 4200 - DNA, 60 bp, Homo sapiens
ttctcttctttattgcattaatctggtttcgatgggccctctttccaaaaatgcaggtat

SEQ ID NO: 4201 - DNA, 60 bp, Homo sapiens
aactttgggtttagtttgttcgtctttctcgaacattctcctggctgtttacgtttacag

SEQ ID NO: 4202 - DNA, 26 bp, Homo sapiens
ggtagtaggaatgaaagagtagaaag

SEQ ID NO: 4203 - DNA, 23 bp, Homo sapiens
cctgagcaacaagagcgaaactc

SEQ ID NO: 4204 - DNA, 26 bp, Homo sapiens
gaagtccattcttgggatgaaacaaa

SEQ ID NO: 4205 - DNA, 24 bp, Homo sapiens
gacattggcagaggtaaataaata

SEQ ID NO: 4206 - DNA, 23 bp, Homo sapiens
gccctctactgcctcaggttctt

SEQ ID NO: 4207 - DNA, 26 bp, Homo sapiens
atgtctttatcttgcttcctttaggg

SEQ ID NO: 4208 - DNA, 24 bp, Homo sapiens
tgtgctaatctggaagactctgtc

SEQ ID NO: 4209 - DNA, 29 bp, Homo sapiens
tactgtactccagcctgggtaatagagcc

SEQ ID NO: 4210 - DNA, 24 bp, Homo sapiens
tgaaagaaagaggttgtcaagaat

SEQ ID NO: 4211 - DNA, 26 bp, Homo sapiens
ggctaaacccacaccctgtaataacc

SEQ ID NO: 4212 - DNA, 23 bp, Homo sapiens
tgccacccagtaggtctcagtct

SEQ ID NO: 4213 - DNA, 24 bp, Homo sapiens
aagtcagaaagccacaagataaat

SEQ ID NO: 4214 - DNA, 26 bp, Homo sapiens
cgtgacgaactgaagcagaccctttc

SEQ ID NO: 4215 - DNA, 24 bp, Homo sapiens
atgtgagtgttccttgtagattac

SEQ ID NO: 4216 - DNA, 26 bp, Homo sapiens
caactgtgacttgactccttgctaag

SEQ ID NO: 4217 - DNA, 28 bp, Homo sapiens
cacagcaagactcagggtggaacagccc

SEQ ID NO: 4218 - DNA, 30 bp, Homo sapiens
taactggttttgtatctaatttagtagtct

SEQ ID NO: 4219 - DNA, 24 bp, Homo sapiens
tttggaaagaggcatcacttttat

SEQ ID NO: 4220 - DNA, 23 bp, Homo sapiens
tgggatttcaggcctgagccacc

SEQ ID NO: 4221 - DNA, 25 bp, Homo sapiens
gggctttctccctactctgtttaga

SEQ ID NO: 4222 - DNA, 23 bp, Homo sapiens
gctggcaggttcggtgtcttgtg

SEQ ID NO: 4223 - DNA, 24 bp, Homo sapiens
cttctcaggtgctgccctcctccg

SEQ ID NO: 4224 - DNA, 28 bp, Homo sapiens
accccttatttggagtgagcagaggcaa

SEQ ID NO: 4225 - DNA, 26 bp, Homo sapiens
ccaatattaaaatgcatcaccaaacc

SEQ ID NO: 4226 - DNA, 26 bp, Homo sapiens
gagatggcttgattgtcttgcccaac

SEQ ID NO: 4227 - DNA, 25 bp, Homo sapiens
acctgaaactcctggtgccacaagc

SEQ ID NO: 4228 - DNA, 28 bp, Homo sapiens
gtgtctctcaggctgctgtccatcatcc

SEQ ID NO: 4229 - DNA, 27 bp, Homo sapiens
atccgcctgccttggcctcccaaagtg

SEQ ID NO: 4230 - DNA, 24 bp, Homo sapiens
gcccgccccagcctcccaaagtgc

SEQ ID NO: 4231 - DNA, 22 bp, Homo sapiens
ggaggctgaggcagaagataga

SEQ ID NO: 4232 - DNA, 23 bp, Homo sapiens
cccaccccgcttgaatagtctgg

SEQ ID NO: 4233 - DNA, 24 bp, Homo sapiens
atctgtctacctcggcctgcaaag

SEQ ID NO: 4234 - DNA, 27 bp, Homo sapiens
atgtcgtcctgcttctggaacagtctc

SEQ ID NO: 4235 - DNA, 23 bp, Homo sapiens
cctcctccaggcttgggaaagtg

SEQ ID NO: 4236 - DNA, 28 bp, Homo sapiens
gcacgccctttccgcagcccaccttttc

SEQ ID NO: 4237 - DNA, 26 bp, Homo sapiens
ctatttgctgaaggttgagtagtctt

SEQ ID NO: 4238 - DNA, 23 bp, Homo sapiens
ctcagttgtggaccagagcagat

SEQ ID NO: 4239 - DNA, 28 bp, Homo sapiens
ctgtcagcattgtgggcaagaccctggg

SEQ ID NO: 4240 - DNA, 23 bp, Homo sapiens
gctttgcttcacaggcttgccca

SEQ ID NO: 4241 - DNA, 28 bp, Homo sapiens
caattctctatggtatattattgttctt

SEQ ID NO: 4242 - DNA, 25 bp, Homo sapiens
ttaaagtagtttattttcacagaaa

SEQ ID NO: 4243 - DNA, 25 bp, Homo sapiens
atctgattttgagtcttgaagggag

SEQ ID NO: 4244 - DNA, 23 bp, Homo sapiens
aagtgctgggaatgcaggtgtga

SEQ ID NO: 4245 - DNA, 25 bp, Homo sapiens
taacaaaatgaaagagaaaaaaaca

SEQ ID NO: 4246 - DNA, 23 bp, Homo sapiens
gcaactgggtagtcttcctcggg

SEQ ID NO: 4247 - DNA, 27 bp, Homo sapiens
gctacttggaaggctgaggggggagaa

SEQ ID NO: 4248 - DNA, 25 bp, Homo sapiens
ggcagaagacacagtgggaccaggg

SEQ ID NO: 4249 - DNA, 28 bp, Homo sapiens
gcctcatttgggcagatgtcttcctttc

SEQ ID NO: 4250 - DNA, 26 bp, Homo sapiens
ccattaggctcccacatccaacattg

SEQ ID NO: 4251 - DNA, 26 bp, Homo sapiens
ctatttgcttccatctcttcttcaag

SEQ ID NO: 4252 - DNA, 28 bp, Homo sapiens
ggtgtcaactgtagtgtttccattttca

SEQ ID NO: 4253 - DNA, 26 bp, Homo sapiens
ggaggtgagggcataatagaaaccat

SEQ ID NO: 4254 - DNA, 24 bp, Homo sapiens
catcaggcttctgggaatggaaat

SEQ ID NO: 4255 - DNA, 23 bp, Homo sapiens
ggctctaagattgaggctgtgat

SEQ ID NO: 4256 - DNA, 24 bp, Homo sapiens
cagtccaaaagccaagaaagcata

SEQ ID NO: 4257 - DNA, 23 bp, Homo sapiens
tccgaccaacccagaccaacctg

SEQ ID NO: 4258 - DNA, 23 bp, Homo sapiens
agagccagtccgagttccaaaac

SEQ ID NO: 4259 - DNA, 24 bp, Homo sapiens
aagtaacagagtaagaagaaatac

SEQ ID NO: 4260 - DNA, 26 bp, Homo sapiens
acaagggtggggttggtggacatttc

SEQ ID NO: 4261 - DNA, 24 bp, Homo sapiens
ttttctgcctcagcctcccaagta

SEQ ID NO: 4262 - DNA, 26 bp, Homo sapiens
ctctaagtaaatcctggtcattcccc

SEQ ID NO: 4263 - DNA, 23 bp, Homo sapiens
gagaccaggaactcaggaccagc

SEQ ID NO: 4264 - DNA, 24 bp, Homo sapiens
aaagtgctgggattacaggcgtga

SEQ ID NO: 4265 - DNA, 26 bp, Homo sapiens
catcctttatcttccctaccccatca

SEQ ID NO: 4266 - DNA, 24 bp, Homo sapiens
aggtctcaagcaagggagcaacat

SEQ ID NO: 4267 - DNA, 25 bp, Homo sapiens
ctgagacaaggcagggcaggtgtta

SEQ ID NO: 4268 - DNA, 28 bp, Homo sapiens
gcccaaactcacaaagcctacagaggga

SEQ ID NO: 4269 - DNA, 25 bp, Homo sapiens
tttactggattaattcttagttgaa

SEQ ID NO: 4270 - DNA, 27 bp, Homo sapiens
caagagattgagactatcctggccaac

SEQ ID NO: 4271 - DNA, 24 bp, Homo sapiens
ttgcccaggctggagtgtagtggc

SEQ ID NO: 4272 - DNA, 26 bp, Homo sapiens
ctcccactctctacctctccctaagt

SEQ ID NO: 4273 - DNA, 23 bp, Homo sapiens
gacccgtcccctgataactgatg

SEQ ID NO: 4274 - DNA, 28 bp, Homo sapiens
gctcaatgaactatgtgctgctgtaagc

SEQ ID NO: 4275 - DNA, 28 bp, Homo sapiens
gggctccgcacaaggcaggtaacattcc

SEQ ID NO: 4276 - DNA, 26 bp, Homo sapiens
ggcaggagaatcgcttgaacccagga

SEQ ID NO: 4277 - DNA, 26 bp, Homo sapiens
gcttcccattagcacaacactgccaa

SEQ ID NO: 4278 - DNA, 26 bp, Homo sapiens
aagtctactcacatcttcctgctgct

SEQ ID NO: 4279 - DNA, 28 bp, Homo sapiens
accctccacgccacctccgaatcagacc

SEQ ID NO: 4280 - DNA, 23 bp, Homo sapiens
ggttggggctcctcatcccaaca

SEQ ID NO: 4281 - DNA, 27 bp, Homo sapiens
gataatctcattgtggttttaacttgt

SEQ ID NO: 4282 - DNA, 25 bp, Homo sapiens
ttgattaatgatcctgtgtctaagt

SEQ ID NO: 4283 - DNA, 23 bp, Homo sapiens
gagtgaccaccaccgctcaacta

SEQ ID NO: 4284 - DNA, 28 bp, Homo sapiens
tgcttacaaagagatccttatcaccctg

SEQ ID NO: 4285 - DNA, 26 bp, Homo sapiens
tatgtattctgctggttttaggtggg

SEQ ID NO: 4286 - DNA, 23 bp, Homo sapiens
caccacacaacacaccctgccta

SEQ ID NO: 4287 - DNA, 27 bp, Homo sapiens
ctcagtcacctggctacacccaagtgc

SEQ ID NO: 4288 - DNA, 26 bp, Homo sapiens
taagggctcaccagcattggatttgg

SEQ ID NO: 4289 - DNA, 26 bp, Homo sapiens
caccccacactgtcactctttgctct

SEQ ID NO: 4290 - DNA, 27 bp, Homo sapiens
ggaaaggtagggcacgcctgtcatccc

SEQ ID NO: 4291 - DNA, 23 bp, Homo sapiens
ctgacacgatgggaccagtgcca

SEQ ID NO: 4292 - DNA, 27 bp, Homo sapiens
aaatatttgtaacacatatctgataag

SEQ ID NO: 4293 - DNA, 24 bp, Homo sapiens
gtcttgaactcctgacttcaagtg

SEQ ID NO: 4294 - DNA, 22 bp, Homo sapiens
gctcagctaagagtgcaatggc

SEQ ID NO: 4295 - DNA, 28 bp, Homo sapiens
ccttgtaacacatacaaccactggattt

SEQ ID NO: 4296 - DNA, 23 bp, Homo sapiens
ggcggattgcttgaccccaggaa

SEQ ID NO: 4297 - DNA, 23 bp, Homo sapiens
cacacccacgagtcagaggtaac

SEQ ID NO: 4298 - DNA, 23 bp, Homo sapiens
tactggattaattcttagttgaa

SEQ ID NO: 4299 - DNA, 27 bp, Homo sapiens
cattttccacccaccttcccacacccg

SEQ ID NO: 4300 - DNA, 23 bp, Homo sapiens
gcggcggcgaggcttgagcagtg

SEQ ID NO: 4301 - DNA, 26 bp, Homo sapiens
gcccaccccatagtaaaagacttgac

SEQ ID NO: 4302 - DNA, 26 bp, Homo sapiens
gccttgagccaatgttgaacccagta

SEQ ID NO: 4303 - DNA, 28 bp, Homo sapiens
cacgatgagtatgaagggcagagcgttt

SEQ ID NO: 4304 - DNA, 60 bp, Homo sapiens
tttttgtatttttaatagagaaatggcctcgaaggagctaaagtgagtgaagcacatagt

SEQ ID NO: 4305 - DNA, 60 bp, Homo sapiens
ttttctttctttcatttttttttttttttcgacttaatagactcctccttctcatcatca

SEQ ID NO: 4306 - DNA, 60 bp, Homo sapiens
agcaaaaagtgaagactgcttgactttttcgaaaaggcctttggtcaaacgatcatattt

SEQ ID NO: 4307 - DNA, 60 bp, Homo sapiens
tataagacagtaatttcagaattactgttcgatagatctcatactttggttttaacactg

SEQ ID NO: 4308 - DNA, 60 bp, Homo sapiens
tagtgtttgataacacagggaaagtctttcgaagtattactattctcactttatagatga

SEQ ID NO: 4309 - DNA, 60 bp, Homo sapiens
ttttctttatttcttttttttttttttttcgagtacttggcaccaccgcgccggaagggc

SEQ ID NO: 4310 - DNA, 60 bp, Homo sapiens
gatgtctgtaatttattcaaagattctctcgaagaaaaaagcaataagaagcctcagcaa

SEQ ID NO: 4311 - DNA, 60 bp, Homo sapiens
taactcatagtctaatacataagcacaatcgagaggcactaaaaattcaatttggactat

SEQ ID NO: 4312 - DNA, 60 bp, Homo sapiens
gcattgtttcttcattttattttatttttcgatcagtcataatcagtcaatcatggcagt

SEQ ID NO: 4313 - DNA, 60 bp, Homo sapiens
aatgtacatactacacaacagacaaatctcgatgaaagtaggcaaagaatataattttgg

SEQ ID NO: 4314 - DNA, 60 bp, Homo sapiens
aattaaaagaaagtaatggaagaattgatcgacttttataaacgggggcacgtgttcagg

SEQ ID NO: 4315 - DNA, 60 bp, Homo sapiens
aaaaaaataaataaaataaagcagggtttcgaataaaataaaattagggccaggcatgat

SEQ ID NO: 4316 - DNA, 60 bp, Homo sapiens
tcttaatttgattttctctggctcagaatcgagatattacactccagcctgggtgacgga

SEQ ID NO: 4317 - DNA, 60 bp, Homo sapiens
tctttactaaagagaatctatcttgtattcgaggttcagaaatattgtgcaacttttaca

SEQ ID NO: 4318 - DNA, 60 bp, Homo sapiens
cattcttttcgtttgaatttgtctttcctcgaaaaaaattacattccattcaacaactaa

SEQ ID NO: 4319 - DNA, 60 bp, Homo sapiens
tccatggtttctcataaaaatcagtcattcgatacaaggttttactgtgtcacccaggct

SEQ ID NO: 4320 - DNA, 60 bp, Homo sapiens
aactcatacattatctatttactgaaaatcgatagatgcagaaaaggtcttcaataaaat

SEQ ID NO: 4321 - DNA, 60 bp, Homo sapiens
attttgaaagcagcaggagtaaaactcttcgatatgaacatttttacggttattatgttt

SEQ ID NO: 4322 - DNA, 60 bp, Homo sapiens
ggtatgtattttacatctaaagtacatctcgatcatatgcttaaaactccagccacagtg

SEQ ID NO: 4323 - DNA, 60 bp, Homo sapiens; identical to SEQ ID NO: 4316

SEQ ID NO: 4324 - DNA, 60 bp, Homo sapiens
tgataatgaaatgaaaagaagtttcacctcgaacagaagttatttaaattccctatggct

SEQ ID NO: 4325 - DNA, 60 bp, Homo sapiens
ctaaattccaaatctcatttaaataccatcgatctgttttaactttttaaaattttgcaa

SEQ ID NO: 4326 - DNA, 60 bp, Homo sapiens
tgatttttcctttatgcttctatgttattcgatactttataaaatgaaaaacctcttctt

SEQ ID NO: 4327 - DNA, 60 bp, Homo sapiens
atcataattagagaaagtacttctcaaatcgattgtgatgaccgagacttgttctcagac

SEQ ID NO: 4328 - DNA, 60 bp, Homo sapiens
ttctctgtttaatatatatattttttcttcgaatcgcaataacagcaaacaatacaggtt

SEQ ID NO: 4329 - DNA, 60 bp, Homo sapiens
tttaatcattacaccttgtaaacaagtatcgataaaaatgtacttcaaaaattggattgg

SEQ ID NO: 4330 - DNA, 60 bp, Homo sapiens
cacctagctaattttttaaaattttttgtcgacgtggcgtgcccggcgcgcacctgtcct

SEQ ID NO: 4331 - DNA, 60 bp, Homo sapiens
tattacagaaaaaaaaaaatggatctcttcgatcgtatctcactggagcttcaaactcct

SEQ ID NO: 4332 - DNA, 60 bp, Homo sapiens
ttgataatgatatagtaatgtagtttcatcgaaattccaaaaaactgcatttttagaacc

SEQ ID NO: 4333 - DNA, 60 bp, Homo sapiens
ggcctctacccgcggggccccgcgcgcgtcgaacacctcttatatgtaatgtataaaatt

SEQ ID NO: 4334 - DNA, 60 bp, Homo sapiens
aaaatggcatattatatcaatctttcactcgacctgcggcccccgggagccccctccccc

SEQ ID NO: 4335 - DNA, 60 bp, Homo sapiens
ggaccaccattatatatgtggtcccttgtcgaactatgctctatgttcttttagatgcaa

SEQ ID NO: 4336 - DNA, 60 bp, Homo sapiens
gtaaatgagctatcgcctcatttactcatcgagaccatctcccccggagacggtaccggg

SEQ ID NO: 4337 - DNA, 60 bp, Homo sapiens
tagcttaccttaagatatctttgaaatatcgatttttcttgggtttactatataccaggc

SEQ ID NO: 4338 - DNA, 60 bp, Homo sapiens
ttaatctagtcatcacaattttccactatcgatagtgttgtaagatgtgtttgcctactc

SEQ ID NO: 4339 - DNA, 60 bp, Homo sapiens
aaacatgaaagaaagtaaacatgaaaaatcgagttcacagctgtggaaagaaacttcacg

SEQ ID NO: 4340 - DNA, 60 bp, Homo sapiens
tacagaatgtgatgaaagtgaaaattattcgatctgctggaatcatgaaagtctaaattt

SEQ ID NO: 4341 - DNA, 60 bp, Homo sapiens
aaactttaaaacaaaatgaagttctaattcgaacattcaaattccctaaagaaaagagag

SEQ ID NO: 4342 - DNA, 60 bp, Homo sapiens
aagctttttagtaacatgtttttcttaatcgaatggtctgttcaagactattttatagtg

SEQ ID NO: 4343 - DNA, 60 bp, Homo sapiens
agattagtttcttatgacatattcatagtcgagatagagtatgtaatcattttatgattt

SEQ ID NO: 4344 - DNA, 60 bp, Homo sapiens
tgagactagagttattttcatctgattctcgaatgtagcttacctactgcatttgaagaa

SEQ ID NO: 4345 - DNA, 60 bp, Homo sapiens
tctaaccattatgagtagatattaatcttcgagagcataaaaatttccttaaactgatca

SEQ ID NO: 4346 - DNA, 60 bp, Homo sapiens
ttcatatttaggcagaaaaaaacagctttcgaagaccaggacaaggtactgtcccggaac

SEQ ID NO: 4347 - DNA, 60 bp, Homo sapiens
ctatttaaatcaaggacttaaaaagtcctcgacaagaggtatgaaggttgagacctctct

SEQ ID NO: 4348 - DNA, 60 bp, Homo sapiens
atatatggctttttaatggctggtaagatcgacataaggatatatagatcagagaaacat

SEQ ID NO: 4349 - DNA, 60 bp, Homo sapiens
aaaatgttaattagaatttatttggctttcgaatgccttttgggtatctgtgggagaagt

SEQ ID NO: 4350 - DNA, 60 bp, Homo sapiens
aggaaaaatatatagctaaagatgtctctcgaggtactccagttttttatttttataata

SEQ ID NO: 4351 - DNA, 60 bp, Homo sapiens
atcttcaggtcgtataaatcttttgccttcgatatatactgtacatctcaagaaatatgt

SEQ ID NO: 4352 - DNA, 60 bp, Homo sapiens
ttttttaaaaaagttagtggatgagcattcgaaaagggagatgtcatctacattggtggc

SEQ ID NO: 4353 - DNA, 60 bp, Homo sapiens
agattctgtgtgttgccagaatcacaactcgaatgcctaaaaagcctttattcttataaa

SEQ ID NO: 4354 - DNA, 60 bp, Homo sapiens
aaaacagcttctttgaaacccttttaaatcgacctcccaatttttatttttattttttta

SEQ ID NO: 4355 - DNA, 25 bp, Homo sapiens
aacaatgaaaaaaaaaggtgttttt

SEQ ID NO: 4356 - DNA, 26 bp, Homo sapiens
cagtggagttgctgggttattgggta

SEQ ID NO: 4357 - DNA, 23 bp, Homo sapiens
ccactggcatctcctccctgttc

SEQ ID NO: 4358 - DNA, 28 bp, Homo sapiens
gtcttttacttcagggaccccaggtgtc

SEQ ID NO: 4359 - DNA, 26 bp, Homo sapiens
gaaagcctctaacagtgtctggaagt

SEQ ID NO: 4360 - DNA, 23 bp, Homo sapiens
caggcgagggtcccaccaggcat

SEQ ID NO: 4361 - DNA, 25 bp, Homo sapiens
actgtggccatgaatggcccacatt

SEQ ID NO: 4362 - DNA, 28 bp, Homo sapiens
gagaagccactaagcctactttacctca

SEQ ID NO: 4363 - DNA, 23 bp, Homo sapiens
cagtccccagtcttccttgtccc

SEQ ID NO: 4364 - DNA, 28 bp, Homo sapiens
ggcttccatccgtcactcagtcctgtag

SEQ ID NO: 4365 - DNA, 28 bp, Homo sapiens
gtaacagcaacttgtcaaacctaagcat

SEQ ID NO: 4366 - DNA, 24 bp, Homo sapiens
cagctacacgggaggctgaggcag

SEQ ID NO: 4367 - DNA, 23 bp, Homo sapiens
ccattccttcctccccaccgaga

SEQ ID NO: 4368 - DNA, 28 bp, Homo sapiens
tgtgtgtgtgttcactatttctgactca

SEQ ID NO: 4369 - DNA, 24 bp, Homo sapiens
gtgggactctgccaggtgcggtgg

SEQ ID NO: 4370 - DNA, 25 bp, Homo sapiens
ccccttaggatgttttaattttacc

SEQ ID NO: 4371 - DNA, 27 bp, Homo sapiens
ctcccacctgcccagccttcagaggtt

SEQ ID NO: 4372 - DNA, 22 bp, Homo sapiens
gattcaacaagctgaaagaacg

SEQ ID NO: 4373 - DNA, 28 bp, Homo sapiens
ggataagcctttactactcaggaagtgt

SEQ ID NO: 4374 - DNA, 23 bp, Homo sapiens
ccattccttcctccccaccgaga

SEQ ID NO: 4375 - DNA, 27 bp, Homo sapiens
cccaggaagggcaggtgttggacaggc

SEQ ID NO: 4376 - DNA, 26 bp, Homo sapiens
ccacacgcagaatacatccatcccat

SEQ ID NO: 4377 - DNA, 25 bp, Homo sapiens
gaggctggaggttgcagtgaagata

SEQ ID NO: 4378 - DNA, 26 bp, Homo sapiens
tggaccacagaaccctcagacaccta

SEQ ID NO: 4379 - DNA, 28 bp, Homo sapiens
cgccctgcttggcaaagatgttccctgg

SEQ ID NO: 4380 - DNA, 26 bp, Homo sapiens
ccagtgttcggtagtatggtagggaa

SEQ ID NO: 4381 - DNA, 24 bp, Homo sapiens
gcccagggtagcatgcagtggtgt

SEQ ID NO: 4382 - DNA, 28 bp, Homo sapiens
cctactctcctgatgttccaaatggtcc

SEQ ID NO: 4383 - DNA, 26 bp, Homo sapiens
gggcgggcaggatgaataagcagagc

SEQ ID NO: 4384 - DNA, 23 bp, Homo sapiens
tcccttccctccccactcgcagg

SEQ ID NO: 4385 - DNA, 28 bp, Homo sapiens
tgggctaccagagacctactcagactta

SEQ ID NO: 4386 - DNA, 27 bp, Homo sapiens
ctgccatctcctatgataacagttcct

SEQ ID NO: 4387 - DNA, 23 bp, Homo sapiens
ggagggctgtgggtaggcaggct

SEQ ID NO: 4388 - DNA, 24 bp, Homo sapiens
actaaaagataacttttccaaatt

SEQ ID NO: 4389 - DNA, 23 bp, Homo sapiens
ggctccatcaccaggaaggtctg

SEQ ID NO: 4390 - DNA, 23 bp, Homo sapiens
gcttctcccacactccaggtcat

SEQ ID NO: 4391 - DNA, 26 bp, Homo sapiens
ttgggagttctttccttgggtgttac

SEQ ID NO: 4392 - DNA, 26 bp, Homo sapiens
cacatagttgcttctcttcaaggtgt

SEQ ID NO: 4393 - DNA, 26 bp, Homo sapiens
ctgtgatactaactgctggcgactca

SEQ ID NO: 4394 - DNA, 26 bp, Homo sapiens
gaagaaactgaggcttgccaaagtct

SEQ ID NO: 4395 - DNA, 26 bp, Homo sapiens
ggacttcaaggaggtctctggcttca

SEQ ID NO: 4396 - DNA, 26 bp, Homo sapiens
gccaaagactcctctgggaatccaac

SEQ ID NO: 4397 - DNA, 26 bp, Homo sapiens
gctgaggagagaagagccaggcaaat

SEQ ID NO: 4398 - DNA, 26 bp, Homo sapiens
gtgtttactttgttccagaggtcacc

SEQ ID NO: 4399 - DNA, 26 bp, Homo sapiens
ctttccagagaaggtgtgtgcgtttc

SEQ ID NO: 4400 - DNA, 26 bp, Homo sapiens
ggaaaaggctgacctacccaaaccag

SEQ ID NO: 4401 - DNA, 26 bp, Homo sapiens
ggatggttggttctcacttcagataa

SEQ ID NO: 4402 - DNA, 26 bp, Homo sapiens
gaagcagactccacaaacccttggct

SEQ ID NO: 4403 - DNA, 23 bp, Homo sapiens
ggactgaggtctgtgtgggaggt

SEQ ID NO: 4404 - DNA, 26 bp, Homo sapiens
cgtcaagggatgtcagtgtttacgcc

SEQ ID NO: 4405 - DNA, 23 bp, Homo sapiens
gcacaggcaaacgctctaagggc

SEQ ID NO: 4406 - DNA, 21 bp, Homo sapiens
aatgaatgcccaagtgaaata

SEQ ID NO: 4407 - DNA, 26 bp, Homo sapiens
atgtgattgagggtaactgtgggaca

SEQ ID NO: 4408 - DNA, 23 bp, Homo sapiens
gcagtcctatcacttgggaggct

SEQ ID NO: 4409 - DNA, 28 bp, Homo sapiens
gccaactttatgggcaggctgtgagaat

SEQ ID NO: 4410 - DNA, 26 bp, Homo sapiens
ggatactaactgtgctactttggagc

SEQ ID NO: 4411 - DNA, 28 bp, Homo sapiens
gcgactctggttggtggactgctgggtg

SEQ ID NO: 4412 - DNA, 26 bp, Homo sapiens
aattttggggtttatatttttgaaag

SEQ ID NO: 4413 - DNA, 28 bp, Homo sapiens
gcacacaaacctccaccactgtcaacga

SEQ ID NO: 4414 - DNA, 23 bp, Homo sapiens
tgtaactctccccaggtcactgc

SEQ ID NO: 4415 - DNA, 28 bp, Homo sapiens
ggtttgagcaggtggcattcccttagcc

SEQ ID NO: 4416 - DNA, 27 bp, Homo sapiens
gagcacgcacagacataaagatgggaa

SEQ ID NO: 4417 - DNA, 25 bp, Homo sapiens
actcgggagacggaggttgcagtga

SEQ ID NO: 4418 - DNA, 23 bp, Homo sapiens
tgccattagtgagcacctctggg

SEQ ID NO: 4419 - DNA, 28 bp, Homo sapiens
ctattatttgggatgtctggagttgaaa

SEQ ID NO: 4420 - DNA, 28 bp, Homo sapiens
caagttccctcaacgcactaagcctcag

SEQ ID NO: 4421 - DNA, 25 bp, Homo sapiens
gtattttttgtagagacggagtttc

SEQ ID NO: 4422 - DNA, 24 bp, Homo sapiens
gaaaaccagcacaagacaaggatg

SEQ ID NO: 4423 - DNA, 25 bp, Homo sapiens
tacagctgtaggacaaacacatcat

SEQ ID NO: 4424 - DNA, 28 bp, Homo sapiens
cccataatccccagcagggtttcctaat

SEQ ID NO: 4425 - DNA, 23 bp, Homo sapiens
tgccattagtgagcacctctggg

SEQ ID NO: 4426 - DNA, 26 bp, Homo sapiens
ggacacactggcattccctattgggc

SEQ ID NO: 4427 - DNA, 26 bp, Homo sapiens
cctacaaggattctgtctgaccctga

SEQ ID NO: 4428 - DNA, 29 bp, Homo sapiens
ctatatatgccaggcacagtggctcccga

SEQ ID NO: 4429 - DNA, 26 bp, Homo sapiens
cactgtcaggttctcaaatgccgttt

SEQ ID NO: 4430 - DNA, 26 bp, Homo sapiens
gggcaactcgcttacccactctgtgc

SEQ ID NO: 4431 - DNA, 26 bp, Homo sapiens
ggacataagcccaaacaggaacactg

SEQ ID NO: 4432 - DNA, 25 bp, Homo sapiens
cagagacccgagtggctcccagcag

SEQ ID NO: 4433 - DNA, 28 bp, Homo sapiens
ggagcaagggaaacggctacacagatgt

SEQ ID NO: 4434 - DNA, 28 bp, Homo sapiens
taaagaaaggagcaagccaaggatgcct

SEQ ID NO: 4435 - DNA, 28 bp, Homo sapiens
ctgctcagaaggaaaggtgtatttgtcc

SEQ ID NO: 4436 - DNA, 25 bp, Homo sapiens
cgggagggaaaggacaacggagccg

SEQ ID NO: 4437 - DNA, 28 bp, Homo sapiens
gctggttgctgtgaactactttgctcca

SEQ ID NO: 4438 - DNA, 28 bp, Homo sapiens
accctccacgccacctccgaatcagacc

SEQ ID NO: 4439 - DNA, 25 bp, Homo sapiens
aaaaactcattatataaagttttaa

SEQ ID NO: 4440 - DNA, 23 bp, Homo sapiens
ctggagagtgggtgggtctgaat

SEQ ID NO: 4441 - DNA, 23 bp, Homo sapiens
tcattcctgccctgtggtcccca

SEQ ID NO: 4442 - DNA, 26 bp, Homo sapiens
tcaagtccgtgacacctgtggtttgc

SEQ ID NO: 4443 - DNA, 26 bp, Homo sapiens
aaaagcacacccagaatggctcccac

SEQ ID NO: 4444 - DNA, 26 bp, Homo sapiens
aggaagcccagatgctgtgtggtttt

SEQ ID NO: 4445 - DNA, 26 bp, Homo sapiens
gcagaagcattccagggtagaaaaca

SEQ ID NO: 4446 - DNA, 26 bp, Homo sapiens
gcctgtttctaccagtttcagtctat

SEQ ID NO: 4447 - DNA, 26 bp, Homo sapiens
gaatcctccctttcctttccttgatg

SEQ ID NO: 4448 - DNA, 26 bp, Homo sapiens
cactaaaccagttcaatcctcggctt

SEQ ID NO: 4449 - DNA, 26 bp, Homo sapiens
ggaaagaaagcaggatggagcagagc

SEQ ID NO: 4450 - DNA, 26 bp, Homo sapiens
gacgctttgcctacttacagttcacc

SEQ ID NO: 4451 - DNA, 26 bp, Homo sapiens
gcaacactgtcacaaaatgtcccact

SEQ ID NO: 4452 - DNA, 26 bp, Homo sapiens
cccagcacaagtctaccaccttatgc

SEQ ID NO: 4453 - DNA, 26 bp, Homo sapiens
gctgtggactgggtaaataaagtgtg

SEQ ID NO: 4454 - DNA, 23 bp, Homo sapiens
ctccagcacagccttgggttaca

SEQ ID NO: 4455 - DNA, 26 bp, Homo sapiens
gtcactggacttttgaatagcaacac

SEQ ID NO: 4456 - DNA, 23 bp, Homo sapiens
gtgggaggactgttcattgaggc

SEQ ID NO: 4457 - DNA, 60 bp, Homo sapiens
cgttaggtgagtttattttcaaagactttcgatggttttaaaaaatgtatcaagtccaca

SEQ ID NO: 4458 - DNA, 60 bp, Homo sapiens
tgatttactttaaaatactttcgtgcaatcgatgtcctagtttttgtactaggtggtgga

SEQ ID NO: 4459 - DNA, 60 bp, Homo sapiens
aatgtattgctgctgaaacattaacctttcgattctgcttttgtttttgttttttccctt

SEQ ID NO: 4460 - DNA, 60 bp, Homo sapiens
atatagtacaaacatatattaatggtaatcgagtttgtaccacaaagccattttgattag

SEQ ID NO: 4461 - DNA, 60 bp, Homo sapiens
caccaccaataaacatttctagacttgctcgattatgttagtaattacactagtaatatc

SEQ ID NO: 4462 - DNA, 60 bp, Homo sapiens
atgctatgtctcttttatttttaacttctcgaatatgagccatgtttctatgcagaattc

SEQ ID NO: 4463 - DNA, 60 bp, Homo sapiens
gcttactcagaacttaaaaatttcataatcgaacctccttctggccaaagagacttttca

SEQ ID NO: 4464 - DNA, 60 bp, Homo sapiens
ttctaaaacagttttttatttgagatcttcgattttaacttggagaaactttgctctgct

SEQ ID NO: 4465 - DNA, 60 bp, Homo sapiens
cagcaagcaataatgtacataatataactcgactttcttaaaaggcgtgtatattcaaaa

SEQ ID NO: 4466 - DNA, 60 bp, Homo sapiens
gtaagaatactgatgtccctctatatactcgattcacttttatgcttagaagccacattg

SEQ ID NO: 4467 - DNA, 60 bp, Homo sapiens
ttttttttttttttaacagcaatgttcatcgaaaggaataatgttgttctttttagaaaa

SEQ ID NO: 4468 - DNA, 60 bp, Homo sapiens
tataaataccagagaagaagccatattttcgaagggcatgaacatttttatgactcttgg

SEQ ID NO: 4469 - DNA, 60 bp, Homo sapiens
tacatttttagctcatcataaaagatattcgatacaccaagcagacaaaattctggcttg

SEQ ID NO: 4470 - DNA, 60 bp, Homo sapiens
atatttaatgtcctatatctgcagatattcgacacctgtttgtcactgtagcagtaaaga

SEQ ID NO: 4471 - DNA, 60 bp, Homo sapiens
aactttaaaatttaattactgttactattcgataaatatgatactcctctccacttactt

SEQ ID NO: 4472 - DNA, 60 bp, Homo sapiens
acatctagatgaagtttaaaatgtaagatcgacagaccttgcacatttgtatgcgaagtc

SEQ ID NO: 4473 - DNA, 60 bp, Homo sapiens
gattcctttgtgagaatcataccttccttcgacaatgggttattcaggaatttaaacttt

SEQ ID NO: 4474 - DNA, 60 bp, Homo sapiens
aagaaaattttttctctaagcactctgatcgatgaatcaacattttccaaaataatacat

SEQ ID NO: 4475 - DNA, 60 bp, Homo sapiens
ctctgcttccctttatttacatcattagtcgatataactggatgaatatctactgttttt

SEQ ID NO: 4476 - DNA, 60 bp, Homo sapiens
ttcattagaatccacttcattaaatctttcgaagatgggatactattgacaaggggtcac

SEQ ID NO: 4477 - DNA, 60 bp, Homo sapiens
ctatattgtagctctattttctctaaattcgaacactcttgtcttgccctcatttgagcc

SEQ ID NO: 4478 - DNA, 60 bp, Homo sapiens
gttaagtggtgtactttttgaaaatccatcgatatatactgtacatctcaagaaatatgt

SEQ ID NO: 4479 - DNA, 60 bp, Homo sapiens
taagccagtttaattgaataacgaatcctcgacatatctctttcagggacattcaaatca

SEQ ID NO: 4480 - DNA, 60 bp, Homo sapiens
acattcagctataaaaaggaataaagtatcgagagctcacctctgaaagcacatgaggga

SEQ ID NO: 4481 - DNA, 60 bp, Homo sapiens
ctagtttccctagagcttactgataatctcgaagaggaaaatttttcagacattaatttg

SEQ ID NO: 4482 - DNA, 60 bp, Homo sapiens
tgataatattatttatttgaaaagtttctcgatactagaattttacactcagcaagtcag

SEQ ID NO: 4483 - DNA, 60 bp, Homo sapiens
ttcaattttggtcaatttatttcaaccatcgaaactttccaaattcatttgtttaaatct

SEQ ID NO: 4484 - DNA, 60 bp, Homo sapiens
taagaacagagatggtattttctttctttcgattgagtagtttcactgagggggtacaaa

SEQ ID NO: 4485 - DNA, 60 bp, Homo sapiens
catcatttcctacactggaaattcctgatcgacgctcatcctgcacggcggcggcaccgt

SEQ ID NO: 4486 - DNA, 60 bp, Homo sapiens
atttcttgtatctctaggtgatgtatgatcgaccttttccttgagttctagaattacata

SEQ ID NO: 4487 - DNA, 60 bp, Homo sapiens
tctctctgatgcatctgctttggataggtcgagctgtttttttctgaaggcaatttattg

SEQ ID NO: 4488 - DNA, 60 bp, Homo sapiens
atcttcaggtcgtataaatcttttgccttcgaacagaaattccttttcatattttcaaaa

SEQ ID NO: 4489 - DNA, 60 bp, Homo sapiens
tgcactcagaaagtgatcagctcacatttcgagatatgctaagaagttggaaaatgttgg

SEQ ID NO: 4490 - DNA, 60 bp, Homo sapiens
tgatttactttaaaatactttcgtgcaatcgagtaacatgcttcttgatatcaacagtct

SEQ ID NO: 4491 - DNA, 60 bp, Homo sapiens
gcccactaaatagtaatattaggatctatcgaggtgggtcaatttgtcaaattaaaagaa

SEQ ID NO: 4492 - DNA, 60 bp, Homo sapiens
ttactacaattactatattctattaatatcgagggaaacctactctctcttcaaggccaa

SEQ ID NO: 4493 - DNA, 60 bp, Homo sapiens
ttgcagactagaattcatccaaaacttttcgagtttgccaggatttagaaagatcattgt

SEQ ID NO: 4494 - DNA, 60 bp, Homo sapiens
tcattttaccgagtgtaaattgttgttttcgactccatttcgcttctaacctctgagctg

SEQ ID NO: 4495 - DNA, 60 bp, Homo sapiens
atatagtatggattctgatattttgatatcgatgtttaccagaaactgctttttaaaaaa

SEQ ID NO: 4496 - DNA, 60 bp, Homo sapiens
gtcctaatattttatacataaaccagtttcgagttgatgcacaaaaattttcatcccatt

SEQ ID NO: 4497 - DNA, 60 bp, Homo sapiens
actatttttaagtgcacagtttaacaattcgattcagctggggaaaaatgaaaataacaa

SEQ ID NO: 4498 - DNA, 60 bp, Homo sapiens; identical to SEQ ID NO: 4316

SEQ ID NO: 4499 - DNA, 60 bp, Homo sapiens
actatttttaagtgcacagtttaacaattcgagaattgaagacaaaatcagagtggtcca

SEQ ID NO: 4500 - DNA, 60 bp, Homo sapiens
ccttgataggatttggaaaaatattagatcgaaaacagaaagcagataaggattcccatc

SEQ ID NO: 4501 - DNA, 60 bp, Homo sapiens
tcttttttagacaactgtttattagcagtcgaaaatccagttagcttcctccacttcatt

SEQ ID NO: 4502 - DNA, 60 bp, Homo sapiens
tacctatgaatatttactataatagagatcgagctatgtgagtctgagtaagtttcttaa

SEQ ID NO: 4503 - DNA, 60 bp, Homo sapiens
gcaggtgagtcagactttgggattcagttcgagatattacactccagcctgggtgacgga

SEQ ID NO: 4504 - DNA, 60 bp, Homo sapiens
ctttccctgattaattactttctagtaatcgatgaatgaatgaatgaagccaaggaaaat

SEQ ID NO: 4505 - DNA, 60 bp, Homo sapiens
acctgatgctatctttaagtggcagacatcgactgttcttctctttctatggggaagttc

SEQ ID NO: 4506 - DNA, 60 bp, Homo sapiens
tgatttactttaaaatactttcgtgcaatcgataataataataaccattaattgggcagg

SEQ ID NO: 4507 - DNA, 60 bp, Homo sapiens
atctctaaaattgataaattgctgcttatcgagtttggttcagcagagctttctgtaaag

SEQ ID NO: 4508 - DNA, 23 bp, Homo sapiens
ctgagacaaggcagggcaggtgt

SEQ ID NO: 4509 - DNA, 26 bp, Homo sapiens
gtatctcacgcacacaaagggacact

SEQ ID NO: 4510 - DNA, 26 bp, Homo sapiens
agacatcccacacccatcttgcctct

SEQ ID NO: 4511 - DNA, 26 bp, Homo sapiens
gcagtaacagacccaagggcataata

SEQ ID NO: 4512 - DNA, 26 bp, Homo sapiens
ctgaggattcttggtgtttatgggac

SEQ ID NO: 4513 - DNA, 26 bp, Homo sapiens
tttctctaccctttatctacctccta

SEQ ID NO: 4514 - DNA, 23 bp, Homo sapiens
atgctcaatgctgtcccctggtg

SEQ ID NO: 4515 - DNA, 23 bp, Homo sapiens
catacccagcagtgtgacaaggc

SEQ ID NO: 4516 - DNA, 26 bp, Homo sapiens
ctctgcccaggagcacagtaatgaag

SEQ ID NO: 4517 - DNA, 26 bp, Homo sapiens
atgagcctggaacatctggtgatacc

SEQ ID NO: 4518 - DNA, 26 bp, Homo sapiens
ggaagcaaggaagtaggctatggaac

SEQ ID NO: 4519 - DNA, 26 bp, Homo sapiens
tgtgaagggcagtgaataaaggatta

SEQ ID NO: 4520 - DNA, 23 bp, Homo sapiens
tgctgtgtgaccttgggatgtcc

SEQ ID NO: 4521 - DNA, 26 bp, Homo sapiens
ccaaaccaaggaggtgacaatggagg

SEQ ID NO: 4522 - DNA, 23 bp, Homo sapiens
aggcaggcagtccagagatgtgc

SEQ ID NO: 4523 - DNA, 26 bp, Homo sapiens
ctggattctctcaaccccgagtgtgt

SEQ ID NO: 4524 - DNA, 25 bp, Homo sapiens
ccattctctttgggtggcgtggtat

SEQ ID NO: 4525 - DNA, 26 bp, Homo sapiens
gaaggatttgagttcagaggaatgga

SEQ ID NO: 4526 - DNA, 26 bp, Homo sapiens
cctctggtatctttggtcactgtgga

SEQ ID NO: 4527 - DNA, 26 bp, Homo sapiens
aagggaacaaatctaagtgctgtggc

SEQ ID NO: 4528 - DNA, 26 bp, Homo sapiens
gaactactctttgtgttatcttggtc

SEQ ID NO: 4529 - DNA, 26 bp, Homo sapiens
gggacattgaggtgttggtggcattc

SEQ ID NO: 4530 - DNA, 26 bp, Homo sapiens
actggtaaaatctgagaaaagacagc

SEQ ID NO: 4531 - DNA, 23 bp, Homo sapiens
gtccttcagcagggatgagtctg

SEQ ID NO: 4532 - DNA, 26 bp, Homo sapiens
aatactggcaagaacccatctactgc

SEQ ID NO: 4533 - DNA, 26 bp, Homo sapiens
gattgatgtagtcttcagtgttttgc

SEQ ID NO: 4534 - DNA, 26 bp, Homo sapiens
cctgagtggcaagttgttggagacat

SEQ ID NO: 4535 - DNA, 26 bp, Homo sapiens
catcagaagataacttgagcaccgtc

SEQ ID NO: 4536 - DNA, 23 bp, Homo sapiens
aaggcagtctggtctgggtcacc

SEQ ID NO: 4537 - DNA, 23 bp, Homo sapiens
cctctgaaaggcagtgtgggtgt

SEQ ID NO: 4538 - DNA, 23 bp, Homo sapiens
cagggttgccttgggttagggtt

SEQ ID NO: 4539 - DNA, 23 bp, Homo sapiens
gcagactccacaaacccttggct

SEQ ID NO: 4540 - DNA, 26 bp, Homo sapiens
aaggcactggcactctacctaatgtg

SEQ ID NO: 4541 - DNA, 26 bp, Homo sapiens
tatctcacgcacacaaagggacactt

SEQ ID NO: 4542 - DNA, 26 bp, Homo sapiens
gtccagtagtatggtggctgtgaata

SEQ ID NO: 4543 - DNA, 26 bp, Homo sapiens
ccctgccatttgaaaggtatttgcct

SEQ ID NO: 4544 - DNA, 23 bp, Homo sapiens
gaccacaggtatgctgggaatcc

SEQ ID NO: 4545 - DNA, 26 bp, Homo sapiens
ccacacacacagaaaactcaaggctg

SEQ ID NO: 4546 - DNA, 26 bp, Homo sapiens
gagagcgagagcaagagagagttagt

SEQ ID NO: 4547 - DNA, 26 bp, Homo sapiens
aatcaatctcctctggtcgctcccac

SEQ ID NO: 4548 - DNA, 26 bp, Homo sapiens
gctattcagttcctacatcttattcc

SEQ ID NO: 4549 - DNA, 23 bp, Homo sapiens
ccattccttcctccccaccgaga

SEQ ID NO: 4550 - DNA, 26 bp, Homo sapiens
gctattcagttcctacatcttattcc

SEQ ID NO: 4551 - DNA, 26 bp, Homo sapiens
ccccattatctttctatgaacccaca

SEQ ID NO: 4552 - DNA, 23 bp, Homo sapiens
caagagcaaggaccctgagacag

SEQ ID NO: 4553 - DNA, 23 bp, Homo sapiens
tgggagaggagacaaaggcacct

SEQ ID NO: 4554 - DNA, 23 bp, Homo sapiens
cgtgctaaacggatgttctcggg

SEQ ID NO: 4555 - DNA, 23 bp, Homo sapiens
gatagatggtctctgccccagca

SEQ ID NO: 4556 - DNA, 23 bp, Homo sapiens
ccagacagagggtgtaaccaggc

SEQ ID NO: 4557 - DNA, 26 bp, Homo sapiens
cgagtatctcacgcacacaaagggac

SEQ ID NO: 4558 - DNA, 23 bp, Homo sapiens
agcaccctcagaactctttcccc

SEQ ID NO: 4559 - DNA, 23 bp, Homo sapiens
gcctattcctgattggaccccag

SEQ ID NO: 4560 - DNA, 26 bp, Homo sapiens
ccttcctttcccttccctttctgttc

SEQ ID NO: 4561 - DNA, 26 bp, Homo sapiens
gattgttagacctcccattagtgtgt

SEQ ID NO: 4562 - DNA, 26 bp, Homo sapiens
cctcccatttccatcctccagtgaac

SEQ ID NO: 4563 - DNA, 26 bp, Homo sapiens
cgtcaaaggctctcagaccagcaaag

SEQ ID NO: 4564 - DNA, 24 bp, Homo sapiens
agcctgctgtattacctttgtggt

SEQ ID NO: 4565 - DNA, 23 bp, Homo sapiens
agcaacaccgcctccactgccat

SEQ ID NO: 4566 - DNA, 23 bp, Homo sapiens
ggcagtggcttgctctgtgtcct

SEQ ID NO: 4567 - DNA, 26 bp, Homo sapiens
taccctattgctggaggagatgaaaa

SEQ ID NO: 4568 - DNA, 26 bp, Homo sapiens
cgcttttgaatgctgggctatgtgct

SEQ ID NO: 4569 - DNA, 26 bp, Homo sapiens
gtgaaccaccataccgaccctcttta

SEQ ID NO: 4570 - DNA, 26 bp, Homo sapiens
ggcgtcagtgtaaacaaatcaagtca

SEQ ID NO: 4571 - DNA, 24 bp, Homo sapiens
cagaaagatgccagtgagcccagc

SEQ ID NO: 4572 - DNA, 26 bp, Homo sapiens
ccactacagaggatgaatcaacacac

SEQ ID NO: 4573 - DNA, 23 bp, Homo sapiens
ggaacaaagccctgccaatgcct

SEQ ID NO: 4574 - DNA, 26 bp, Homo sapiens
aacagcagaagtccagtagaagttgg

SEQ ID NO: 4575 - DNA, 26 bp, Homo sapiens
ctttgagaagttggtccacatactgc

SEQ ID NO: 4576 - DNA, 26 bp, Homo sapiens
ggaaactgaaaccgtaacaaggaaca

SEQ ID NO: 4577 - DNA, 26 bp, Homo sapiens
gctcaataaagcaaaagacagcagaa

SEQ ID NO: 4578 - DNA, 26 bp, Homo sapiens
gccgcatagagaaatgagtggagggt

SEQ ID NO: 4579 - DNA, 24 bp, Homo sapiens
attgcttgggatgttttgaggctc

SEQ ID NO: 4580 - DNA, 26 bp, Homo sapiens
gctgtggactgggtaaataaagtgtg

SEQ ID NO: 4581 - DNA, 26 bp, Homo sapiens
caaggtgaagtctggagggaaagaga

SEQ ID NO: 4582 - DNA, 23 bp, Homo sapiens
tgtgaggaccagcactgagcagc

SEQ ID NO: 4583 - DNA, 26 bp, Homo sapiens
gaagagttgggaacattatcctaagg

SEQ ID NO: 4584 - DNA, 26 bp, Homo sapiens
gggtctgtcactgtatttctcacctg

SEQ ID NO: 4585 - DNA, 26 bp, Homo sapiens
ggaggcagagtgaataaagggttggt

SEQ ID NO: 4586 - DNA, 26 bp, Homo sapiens
gcctgtggactctttcctctctatcc

SEQ ID NO: 4587 - DNA, 23 bp, Homo sapiens
gtggagatgaaatcacccgaggc

SEQ ID NO: 4588 - DNA, 23 bp, Homo sapiens
gctactgagtgggcaggtggcta

SEQ ID NO: 4589 - DNA, 23 bp, Homo sapiens
agtgaggaaagccctggactccc

SEQ ID NO: 4590 - DNA, 23 bp, Homo sapiens
gaagtcccctggcgaagatgagc

SEQ ID NO: 4591 - DNA, 26 bp, Homo sapiens
gcctctcctttgtttgctgtgtgaca

SEQ ID NO: 4592 - DNA, 26 bp, Homo sapiens
cagagccattcaaggagccaaaaggc

SEQ ID NO: 4593 - DNA, 26 bp, Homo sapiens
ccagagccccaaataaggatggaagc

SEQ ID NO: 4594 - DNA, 26 bp, Homo sapiens
ctacaaccaagatgctaagacagttt

SEQ ID NO: 4595 - DNA, 23 bp, Homo sapiens
agggcgtgctatctttgcctggc

SEQ ID NO: 4596 - DNA, 26 bp, Homo sapiens
gcttgttctacacccaggaatgacca

SEQ ID NO: 4597 - DNA, 26 bp, Homo sapiens
ggtagagagtcttgatgtaacagaat

SEQ ID NO: 4598 - DNA, 26 bp, Homo sapiens
ggctttaggcagaagagtgttcattc

SEQ ID NO: 4599 - DNA, 26 bp, Homo sapiens
ctggctactcttgaaacacccacttg

SEQ ID NO: 4600 - DNA, 23 bp, Homo sapiens
tgccattagtgagcacctctggg

SEQ ID NO: 4601 - DNA, 26 bp, Homo sapiens
gattcccattgtcaagaccaggagac

SEQ ID NO: 4602 - DNA, 26 bp, Homo sapiens
cgtgtgtgaatgactctttgtgcttg

SEQ ID NO: 4603 - DNA, 23 bp, Homo sapiens
cacaagcagcccagccctcctta

SEQ ID NO: 4604 - DNA, 26 bp, Homo sapiens
ccagatactgtgctaaaggcttcgcc

SEQ ID NO: 4605 - DNA, 24 bp, Homo sapiens
ctgccattagtgagcacctctggg

SEQ ID NO: 4606 - DNA, 23 bp, Homo sapiens
caccgtgctgccaagttgactcc

SEQ ID NO: 4607 - DNA, 23 bp, Homo sapiens
cctccttcccattcttggcttcc

SEQ ID NO: 4608 - DNA, 26 bp, Homo sapiens
ccagtctcagtggaggattttgaaga

SEQ ID NO: 4609 - DNA, 23 bp, Homo sapiens
cacctcccctgtcacctgatgtc

SEQ ID NO: 4610 - DNA, 60 bp, Homo sapiens
ttttgcaagttgttactagtactgaatttcgatttactttgtcagcatgtaggacttcct

SEQ ID NO: 4611 - DNA, 60 bp, Homo sapiens
gtggaaaaaagctaatctcataatctagtcgatttacaaaacacaatttaccttttccaa

SEQ ID NO: 4612 - DNA, 60 bp, Homo sapiens
ccttccctcgtattcagtgagattcatttcgaagctctggaatgaattttcttggatcct

SEQ ID NO: 4613 - DNA, 60 bp, Homo sapiens
ccttctacagggaagtgatggaattacttcgaataattcaccctttaccaggcctgggag

SEQ ID NO: 4614 - DNA, 60 bp, Homo sapiens
aaagaaaagtctggatgacaatctttattcgaagcaagtgaatgatagtcaggtaatata

SEQ ID NO: 4615 - DNA, 60 bp, Homo sapiens
caatattatatgtagagattctttcatatcgaccatatgctgtgatgccacaacaagcaa

SEQ ID NO: 4616 - DNA, 60 bp, Homo sapiens
aactggtaataagttatgcctatgaatgtcgaattcatgttttttctcttggaattttct

SEQ ID NO: 4617 - DNA, 60 bp, Homo sapiens
ctttatgataattgctatgttagtagcctcgagaccatgattgtggatcctagttttgga

SEQ ID NO: 4618 - DNA, 60 bp, Homo sapiens
tacctttatttttgaagcatatcttcactcgaggtgtctgaagaaacaccaaaaatgcct

SEQ ID NO: 4619 - DNA, 60 bp, Homo sapiens
caaagtactactttaatttatgacataatcgataactctttcacttggctgccctctcta

SEQ ID NO: 4620 - DNA, 60 bp, Homo sapiens
tatgcatatatgtatatatatgtagctatcgaaaggcaaacaaagacatcctgaaggatc

SEQ ID NO: 4621 - DNA, 60 bp, Homo sapiens
ttatggttttcttccagagtagaaatcttcgattattcttttcttccctgccaccttggg

SEQ ID NO: 4622 - DNA, 60 bp, Homo sapiens
tatatacatatacatatgtatgtatatgtcgactccggtcctcgcggccggccggctaag

SEQ ID NO: 4623 - DNA, 60 bp, Homo sapiens
ttcattctcttttacctgtctattttcctcgacaaattgtaatgaggtttatccacactg

SEQ ID NO: 4624 - DNA, 60 bp, Homo sapiens
gagcctttacatatattagctcatttactcgatgaaagcatcccattgtcttttccatac

SEQ ID NO: 4625 - DNA, 60 bp, Homo sapiens
aattatgtgaccattgtgcttattgttctcgaatttgtggcaatagctgcaaattccagg

SEQ ID NO: 4626 - DNA, 60 bp, Homo sapiens
actccaaaatggtctcattcttactgaatcgacctgtgcttatcccagaattgtttcctg

SEQ ID NO: 4627 - DNA, 60 bp, Homo sapiens
ctaagcagagactaagaatatcttaaagtcgacagtgaagtcaaggctgacaaggtctca

SEQ ID NO: 4628 - DNA, 60 bp, Homo sapiens; identical to SEQ ID NO: 1159

SEQ ID NO: 4629 - DNA, 60 bp, Homo sapiens; identical to SEQ ID NO: 1400

SEQ ID NO: 4630 - DNA, 60 bp, Homo sapiens; identical to SEQ ID NO: 1085

SEQ ID NO: 4631 - DNA, 60 bp, Homo sapiens; identical to SEQ ID NO: 1359

SEQ ID NO: 4632 - DNA, 60 bp, Homo sapiens; identical to SEQ ID NO: 1105

SEQ ID NO: 4633 - DNA, 60 bp, Homo sapiens; identical to SEQ ID NO: 1114

SEQ ID NO: 4634 - DNA, 60 bp, Homo sapiens; identical to SEQ ID NO: 1376

SEQ ID NO: 4635 - DNA, 60 bp, Homo sapiens; identical to SEQ ID NO: 1393

SEQ ID NO: 4636 - DNA, 60 bp, Homo sapiens; identical to SEQ ID NO: 1370

SEQ ID NO: 4637 - DNA, 60 bp, Homo sapiens; identical to SEQ ID NO: 1089

SEQ ID NO: 4638 - DNA, 60 bp, Homo sapiens; identical to SEQ ID NO: 1350

SEQ ID NO: 4639 - DNA, 26 bp, Homo sapiens
gcctaaaacttcagcctaaaggatga

SEQ ID NO: 4640 - DNA, 23 bp, Homo sapiens
acccacttgtcttccacaccagc

SEQ ID NO: 4641 - DNA, 24 bp, Homo sapiens
tgggactcaggactcattgctgcc

SEQ ID NO: 4642 - DNA, 26 bp, Homo sapiens
gccaagtctaacacctgctttgaaga

SEQ ID NO: 4643 - DNA, 23 bp, Homo sapiens
caccttcaggctggcatctccct

SEQ ID NO: 4644 - DNA, 26 bp, Homo sapiens
ccattcttccagagatgtcaaaaccc

SEQ ID NO: 4645 - DNA, 26 bp, Homo sapiens
ctaatacagtcttctacccaaaatgg

SEQ ID NO: 4646 - DNA, 26 bp, Homo sapiens
cacacataatccagagtcagggagag

SEQ ID NO: 4647 - DNA, 26 bp, Homo sapiens
ccatctgctgtcatttcctgtgattc

SEQ ID NO: 4648 - DNA, 26 bp, Homo sapiens
taccaggaataataaagcagggactt

SEQ ID NO: 4649 - DNA, 23 bp, Homo sapiens
gggttgctggctggagtcttctg

SEQ ID NO: 4650 - DNA, 26 bp, Homo sapiens
ctgtctctacccaataatgtcaggtc

SEQ ID NO: 4651 - DNA, 26 bp, Homo sapiens
gaatgctctgttccatctgggtgctg

SEQ ID NO: 4652 - DNA, 23 bp, Homo sapiens
cgcctcactctctactactcagc

SEQ ID NO: 4653 - DNA, 26 bp, Homo sapiens
cactgggctaatgtaaggtttgccat

SEQ ID NO: 4654 - DNA, 26 bp, Homo sapiens
ggcagagaaagttttgtcctcagttc

SEQ ID NO: 4655 - DNA, 26 bp, Homo sapiens
gactgctatcactttgagatggacag

SEQ ID NO: 4656 - DNA, 26 bp, Homo sapiens
aagcacaggtatgggagcacacacag

SEQ ID NO: 4657 - DNA, 26 bp, Homo sapiens
ccactgtcagggaaatagttgaagga

SEQ ID NO: 4658 - DNA, 26 bp, Homo sapiens
aacccctgattcctttcttccctact

SEQ ID NO: 4659 - DNA, 23 bp, Homo sapiens
gccagggtgattagaccaaggag

SEQ ID NO: 4660 - DNA, 25 bp, Homo sapiens
aagagagacgcccagaagccagaaa

SEQ ID NO: 4661 - DNA, 23 bp, Homo sapiens
gcactgccatctgtgggctgaga

SEQ ID NO: 4662 - DNA, 26 bp, Homo sapiens
gatagggttttgccaccttggataag

SEQ ID NO: 4663 - DNA, 26 bp, Homo sapiens
gtcctgttttgaatgcccagttcttt

SEQ ID NO: 4664 - DNA, 23 bp, Homo sapiens
ctatcggcgggctttagcagtgc

SEQ ID NO: 4665 - DNA, 26 bp, Homo sapiens
cctggatggaaacagacacaacacaa

SEQ ID NO: 4666 - DNA, 26 bp, Homo sapiens
attgactgtcttgggaaaagcactta

SEQ ID NO: 4667 - DNA, 24 bp, Homo sapiens
gtagcaaacccacttccctcctgc

SEQ ID NO: 4668 - DNA, 23 bp, Homo sapiens
gcccctcttctttgccaagcact

SEQ ID NO: 4669 - DNA, 26 bp, Homo sapiens
cattcttccctcagccatccatttgg

SEQ ID NO: 4670 - DNA, 26 bp, Homo sapiens
cacagtgggctcagtgtcaacaaacc

SEQ ID NO: 4671 - DNA, 24 bp, Homo sapiens
ccagcaaaaggcaggaatcagtgc

SEQ ID NO: 4672 - DNA, 26 bp, Homo sapiens
gtgtctcggagtctctttgaaccagc

SEQ ID NO: 4673 - DNA, 26 bp, Homo sapiens
ctaccatagcccttttatcaatccag

SEQ ID NO: 4674 - DNA, 26 bp, Homo sapiens
gagaatgtcaccaggattgcccaagc

SEQ ID NO: 4675 - DNA, 26 bp, Homo sapiens
tcccaagtggtccccaaaatgtcttt

SEQ ID NO: 4676 - DNA, 26 bp, Homo sapiens
gtgcctcagttttcctcatccctaag

SEQ ID NO: 4677 - DNA, 26 bp, Homo sapiens
gaaaccagccagatgagagcaacagc

SEQ ID NO: 4678 - DNA, 26 bp, Homo sapiens
tggagactcagaaccattcccaggtc

SEQ ID NO: 4679 - DNA, 23 bp, Homo sapiens
tggcatagccgacctgtgcttgc

SEQ ID NO: 4680 - DNA, 23 bp, Homo sapiens
agagtgggtaggcggtccctcgc

SEQ ID NO: 4681 - DNA, 23 bp, Homo sapiens
gggaacacacacacaggtgacca

SEQ ID NO: 4682 - DNA, 26 bp, Homo sapiens
gccaataccatttccttgaccagggc

SEQ ID NO: 4683 - DNA, 26 bp, Homo sapiens
gagcgtgaagagagtgtcattgaaaa

SEQ ID NO: 4684 - DNA, 23 bp, Homo sapiens
gggaccactgcctcagataaagc

SEQ ID NO: 4685 - DNA, 26 bp, Homo sapiens
gtgtgacctttgctccagtgccctat

SEQ ID NO: 4686 - DNA, 26 bp, Homo sapiens
gggactgagtgacacaaggaccattt

SEQ ID NO: 4687 - DNA, 23 bp, Homo sapiens
ctcttctgtttgtgagggctgcc

SEQ ID NO: 4688 - DNA, 23 bp, Homo sapiens
gccaagggttcagaaagcccagg

SEQ ID NO: 4689 - DNA, 26 bp, Homo sapiens
gccttttattctgtgtgtggctaagc

SEQ ID NO: 4690 - DNA, 26 bp, Homo sapiens
ctctcttggtgtttggaaatctgtgc

SEQ ID NO: 4691 - DNA, 23 bp, Homo sapiens
ggaaagtcccaggctccaggaag

SEQ ID NO: 4692 - DNA, 26 bp, Homo sapiens
ccgacttacggtgtccattattatgc

SEQ ID NO: 4693 - DNA, 26 bp, Homo sapiens
ccattcgccattcttccttacccagc

SEQ ID NO: 4694 - DNA, 26 bp, Homo sapiens
cattccagcattggttggcatttgaa

SEQ ID NO: 4695 - DNA, 26 bp, Homo sapiens
gggcagggtatctaaggcaatggttc

SEQ ID NO: 4696 - DNA, 23 bp, Homo sapiens
gggaatgtatgctgttctcagag

The invention claimed is:

1. A process for determining an autism spectrum disorder (ASD) status in a human individual comprising detecting in the human individual the presence or absence of one or more of the chromosome interactions (i) to (xx) listed below:

(i) the chromosome interaction on chromosome 7 formed by the first region of chromosome position number 106136913 to 106136942 and the second region of chromosome position number 106155637 to 106155666, (ii) the chromosome interaction on chromosome 2 formed by the first region of chromosome position number 209638896 to 209638925 and the second region of chromosome position number 209692609 to 209692638, (iii) the chromosome interaction on chromosome 2 formed by the first region of chromosome position number 39609951 to 39609980 and the second region of chromosome position number 39623227 to 39623256, (iv) the chromosome interaction on chromosome 6 formed by the first region of chromosome position number 46267217 to 46267246 and the second region of chromosome position number 46295957 to 46295986, (v) the chromosome interaction on chromosome 3 formed by the first region of chromosome position number 120809117 to 120809146 and the second region of chromosome position number 120844724 to 120844753, (vi) the chromosome interaction on chromosome 10 formed by the first region of chromosome position number 3161201 to 3161230 and the second region of chromosome position number 3210552 to 3210581, (vii) the chromosome interaction on chromosome 2 formed by the first region of chromosome position number 198099688 to 198099717 and the second region of chromosome position number 198137326 to 198137355, (viii) the chromosome interaction on chromosome 12 formed by the first region of chromosome position number 30144612 to 30144641 and the second region of chromosome position number 30181631 to 30181660, (ix) the chromosome interaction on chromosome 19 formed by the first region of chromosome position number 52224154 to 52224183 and the second region of chromosome position number 52267683 to 52267712, (x) the chromosome interaction on chromosome 6 formed by the first region of chromosome position number 157189220 to 157189249 and the second region of chromosome position number 157240029 to 157240058, (xi) the chromosome interaction on chromosome 7 formed by the first region of chromosome position number 106136913 to 106136942 and the second region of chromosome position number 106183994 to 106184023, (xii) the chromosome interaction on chromosome 21 formed by the first region of chromosome position number 17087460 to 17087489 and the second region of chromosome position number 17114098 to 17114127, (xiii) the chromosome interaction on chromosome 10 formed by the first region of chromosome position number 106496979 to 106497008 and the second region of chromosome position number 106538148 to 106538177, (xiv) the chromosome interaction on chromosome 8 formed by the first region of chromosome position number 31178906 to 31178935 and the second region of chromosome position number 31205591 to 31205620, (xv) the chromosome interaction on chromosome 13 formed by the first region of chromosome position number 34433098 to 34433127 and the second region of chromosome position number 34463900 to 34463929, (xvi) the chromosome interaction on chromosome 5 formed by the first region of chromosome position number 149610434 to 149610463 and the second region of chromosome position number 149663577 to 149663606, (xvii) the chromosome interaction on chromosome 3 formed by the first region of chromosome position number 43042541 to 43042570 and the second region of chromosome position number 43075798 to 43075827, (xviii) the chromosome interaction on chromosome 14 formed by the first region of chromosome position number 99794537 to 99794566 and the second region of chromosome position number 99818383 to 99818412, (xix) the chromosome interaction on chromosome 7 formed by the first region of chromosome position number 22368714 to 22368743 and the second region of chromosome position number 22401548 to 22401577, (xx) the chromosome interaction on chromosome 18 formed by the first region of chromosome position number 58202024 to 58202053 and the second region of chromosome position number 58217905 to 58217934 wherein the presence of any of the chromosome interactions (i) to (xx) is associated with ASD;

wherein detection of the presence or absence of each chromosome interaction is by a process comprising the steps of:

(a) cross-linking of chromosome DNA regions of the human individual which have come together in a chromosome interaction, (b) subjecting the cross-linked DNA regions to cleavage, (c) ligating the cross-linked cleaved DNA ends to form ligated DNA, and (d) detecting the presence or absence of the ligated DNA corresponding to each chromosome interaction to thereby determine the presence or absence of each chromosome interaction;

wherein detecting the presence or absence of the ligated DNA is by quantitative PCR (qPCR) which uses primers capable of amplifying the ligated DNA and a probe which binds the ligation site during the PCR reaction, wherein said probe comprises sequence which is complementary to sequence from each of the chromosome regions that have come together in the chromosome interaction.

2. The process according to claim 1, wherein the presence or absence of at least 1, 5, 8 or 10 of the chromosome interactions (i) to (xx) is determined.

3. The process according to claim 1, wherein the probe comprises:

a fluorophore covalently attached to the 5' end of the probe, and/or a quencher covalently attached to the 3' end of the probe.

4. The process according to claim 1, wherein the individual has been preselected based on a physical characteristic, risk factor or symptom.

5. The process according to claim 4, wherein the individual has been preselected based on having a symptom of, or risk factor for: autistic disorder, childhood autism, Asperger's syndrome, PDD-NOS (Pervasive Development Disorder), childhood disintegrative disorder or addiction.

* * * * *